United States Patent 7,745,391 (HUMAN THROMBOSPONDIN POLYPEPTIDE) - sequence listing, part 144

SEQ ID NO: 376715 - DNA, 877 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacaggtggtggccctagggccgtaggttgctggcccctgttctgaaccaccgagagatac

SEQ ID NO: 376716 - DNA, 1002 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggtctcggctcttatacgggactttaggggcccttccgaacaaagaatgggacaacttcaagtggaagaacatcccggaagattggtctgccccgatgacgaccacactggcaggccgttgagcacatcggtgacatatgtgatcggccagccattcgtaggcacacgcgtgcgtgccgtagagcctcagggggcggacactccagc

SEQ ID NO: 376717 - DNA, 2060 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactggaaagtttatgtggaaattgtcataaaagcatacatccaacaaaaacagtttttcaagaaagtcaatcttttagaatagggagtctgtggcattttcccactaaaatatttcacttggcactttggaggctgaggtgagtgagtcacttgaggtcaggagttcaagaccaggctggcaaacatggtgaaagtgggatgtcattgtgggttggattacatttccctgatagctatgattgagcatctttcatgtacttactggccaatggcattctttgggaagacgtacagatcttaccattttttttttggaaaggccacctcctttgccaaggaaaggaattcacgaagagacccccgcgtctacaaacagcgcgagagtcccacaaaaaaaaaagtgcccaacaacaaattgcgccaatataaaatatattatcaagcacacaatagcaaacaccaaaattaa

SEQ ID NO: 376718 - DNA, 1542 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactgga

SEQ ID NO: 376719 - DNA, 1225 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacaggtaacttttaacaaaagaagagattgattttaattcatatatagttgatatttttacaaaagatttttgtattgtaacatttattttatgaaattaaggcattttggctgagatgtggaaagtttctcaaaggaaaagcatgtttttttgaagtgtgtaatattagcgtgattttacggcaaaatcagatttacagattaaactgatttaataggtaaaactgagtctcaccgtactcctgactataaaagttttcagcttaacgtatactattgacactaattttgtattaatctggaaacttaaaatggcaatccagtgttgactattccccaatttaagccagattgctcaaatgaattctgacttaagtgattctctttgataaaataaaaattaaaagc

SEQ ID NO: 376720 - DNA, 1737 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaaatggagtctcgctgtgacaccctggctggagtacagtggtgtcatctcaactcactgcaacctccgcttcccggcttcaagcaattattctgcctcagccacccgagtagctgggactacaggcgcacaccaccatgcctggaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactgga

SEQ ID NO: 376721 - DNA, 1341 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactgga

SEQ ID NO: 376722 - DNA, 744 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaaagaatgggctttctaaaggacattggggggcgaatacacgaaggaaaaattccctaggtgaacagagacttttttttcaacggaaagggttttccaaacgggggcaacagccaggttggaacccaacacttggtgctttgggcccaattatctttcccttttttaaaccccgatagtggtcgtccaaaccgcgggggcaaatacacctcctcttttatcccccccccccaacaaaaccacaccatctctcgtcacccaaacggcgcgggagcgttggcggtcttcctacactcccca

SEQ ID NO: 376723 - DNA, 538 bp, Homo sapiens
cagaagccccaggagacctcaactcactcgctctccaaaccttgcagcccacgcatcctcctccctagacttcctacttcctgcctcagtctgcatccccaagtctgagaaatgggccaactggggtcagacagcacctactcactctctaagaatcccaaggtctgttatggaaaaatgatcaagaaatcccatttcacccacttacacaatgtgtggccttggccaattaattcatttgagcctcaatgttacgtgggccacttctgtcatggggttgttgtgagtcaaagacaatatctatttgtgaagcattttgtagaagccaaaaacctgtaagatgttgttttgagctctaagaactttctgtaggcgcataagatcttttgaccccaaagactgttgaaggaacaggaagcttctctgggctttcagatcaactctctgtcctggatagaattttggccctaaaatggtaaacaagaggtcggttaagtgtgtacaagatgtaaaaggtcatgtgccatgaaatctcaaa

SEQ ID NO: 376724 - DNA, 420 bp, Homo sapiens
ctgcttagaaggctgagcccagaaattgaggagtcaatcttgatgcttctttctccttcagccgccacatcaatccatcagtaggtcctgtagattctcttcctaaatgcttctcaaatcctttcacctatttcaagtcccactgccactattctagtccaggttgctattatttccatcttcagtagccccatagcttcctaactactctcagggctctcattttcccccttgctaatctattatccacagggggagggtgacccctttctcagatgtgaatatgattatctcattcccacttaaaatgatttgctgccattctccttcccttaatatcatggtcaggtcctggattcaaccccagacttaaagaagtggaatctaccaggaaagttcataaaaattctcgtgacaacc

SEQ ID NO: 376725 - DNA, 529 bp, Homo sapiens
atttatttgtttgtttatttatttatgttttagaaggagtttttctcttgttgcccaggctgaggtgcaatggcgcgatcctggctcaccgcaatgtccccttcccgggtcaagggattgtcctgactcagcgtcctgagtagctgggattacaggcatgcaccaccatgcccagttaattttgtatttttagtagagatggggtttcttcgtgtggatcattctgttctagaactcccgacctcagttgatccgccagcctcaggctcccaaagtgctgggattacaggcgtaagccaccgctcccagcctaaccgattgcttcttttgttctgtagtcttttgccaaaactgttattctctggactcactttcaccttctctcacacatacatgtccctcgtgtccctttgtgtctccagggtcttctatttccacgtaatcttaatttttcatcacatcctggactcatgagtaattaatctgttattctccctgaaagtgcagccttgttgaatagaatgtgttc

SEQ ID NO: 376726 - DNA, 3311 bp, Homo sapiens
ggagtgcccaggatggagtgcagtggctattcacaggtttaatcatagctcactaccgtcttgaatccctgggctcaagtgatcctcctgcctcagcccctgagtagctggtactaaagttaccttccacgctgtatgtccgtgagaaatacaatgaagacggtctgaataatgaactggtaatcttcgataatatgaaacgaatttaagagaacatatcaaagagaaggctctcaaaataggctgctgcaaaagctggtatattgtccggttgctctctcagaatctcgcgtgtcagcccttcaagaagattcccaaatccttgtggaattcggtagtgggtgttggagaatggaatcgacatcttcttggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcactagtgatgtgtatgtatttatatccacttgcaaactgtccttgaagcatgtgaaaaggagtaagaatactatctatgggtagctttcctccccttaatgtgaaaaatgagaactaaagcaaaaagcatcactcactgtacatatacaatgtattttacgtagtgtaaaaaatatggtttagatagtgaatatattaatgaaatcatatgtaaatttatttttagtggctgaataatttaaaacattatgtggaattcactatgtttcccccaatttaggaact

SEQ ID NO: 376727 - DNA, 2051 bp, Homo sapiens
aaaaaactacggcggccgagaaggggcgagtacagcccagtcctgaggtcgcgggaggctgcgaggactgcaaaagggtggagtcggcctcgcccccgcccaggccccgcccctgccgggaacccactttcccagtcctaggcggcggtcagatccttgcaagcatggtcgcgccggggcttgtactcgggctggtgctgccattaatcctgtgggccgacagaagtgcaggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtccaatataaattataacacggatctgtacaattgca

SEQ ID NO: 376728 - DNA, 551 bp, Homo sapiens
aaagactccagtgtgggattctgatacaataaaattagcaatgtctctgctttctagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcaggtatgattgcttcttgggctttgcatgaacagtgtatgttctttgtagtctttcactctgatgttcaccggtgaggggcaattagactgaggattggcacttaagagtcacgtatgctggggtgtgctgcagtaacaacagcaaacaccctcaacatctcagttctctgatgcaccaacaatttatttcttggtcactctctctgttaaaagaaggtcaacagagactttgctcactgtaatcattcatagacccagagcaatagaggctccaagttgacctatgcttccatagtcatcttaaagtgtcacactggcaattcagtgcttccacaca

SEQ ID NO: 376729 - DNA, 2890 bp, Homo sapiens
aaaaaactacggcggccgagaaggggcgagtacagcccagtcctgaggtcgcgggaggctgcgaggactgcaaaagggtggagtcggcctcgcccccgcccaggccccgcccctgccgggaacccactttcccagtcctaggcggcggtcagatccttgcaagcatggtcgcgccggggcttgtactcgggctggtgctgccattaatcctgtgggccgacagaagtgcaggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcacta

SEQ ID NO: 376730 - DNA, 3030 bp, Homo sapiens
ggagtgcccaggatggagtgcagtggctattcacaggtttaatcatagctcactaccgtcttgaatccctgggctcaagtgatcctcctgcctcagcccctgagtagctggtactaaagttaccttccacgctgtatgtccgtgagaaatacaatgaagacggtctgaataatgaactggtaatcttcgataatatgaaacgaatttaagagaacatatcaaagagaaggctctcaaaataggctgctgcaaaagctggtatattgtccggttgctctctcagaatctcgcgtgtcagcccttcaagaagattcccaaatccttgtggaattcggtagtgggtgttggagaatggaatcgacatcttcttggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacagatatttaatgctacaagggagttgtctaacactgcggcatatcagtctgtccgcatcctctctgtctctcccattcaagcagagcaggagctggaggaccttgttgcggttgacttgcagtggtctaagcccacctcagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtccattccatacgattctgtaactggtcccagtaagcactctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaagagctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacgtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggcttataggtaacttgaaatgcttgctttttgttccctagttggtctaagggtctgtattggactaattctgaactacagacaaattggacctcaatgtcatttacttccctcatattaatgggagtgaaatgtctaatacttttgcccctttttatccagagttgtgggaatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcacta

SEQ ID NO: 376731 - DNA, 743 bp, Homo sapiens
tccccagccttaaagaacgctccttttaaattcacagttgtgtaatattgaacttttcacctgtttttcttccctcctaaggtgtgtgttcctagggatggaacctgtacctataaatattcagtaaataggaccaaaactcaaatccatcccttcctctactcatccattcagcaagtatttactgagctgcccccaggtgccaggcactgcacagggcactggggataaggagatgaccagcagatgtggtccctggcctcatggaggccacagtggcacaggcaagcatgccagtaaatgcatagccacacctggtcatgagtgccgtgatggcaaagccagaagctgccagggattaatggagggacccgtgtatgagacacaggggtgcattaaggaaggccttgctgaggcaggggcttgagacctgaagaaataagggaggtgggcagtccaagagcagtgggaagagaacactgcaaatgcagaagccgtgagctggaaacgagccagaagtacccttagagagctgtattcctatggagtttcaattctaggtggcttaaaacaatcccagagaagttcagaatcttgtccaagatcataccattcaggatagacttgcgactataacttgggtgcctcaccttccagcctggggtgtctgactccattgttaattttattataacaatcatgatgacaacgatgaataaagtgaaattgtactgtacaggaaa

SEQ ID NO: 376732 - DNA, 391 bp, Homo sapiens
attttgtgggagtaagttcttaccaatcaaattacattttgttttaatttttatacttgtatctgaattttctaagcaatttattttcctatcaaagaatttgttttgtcaaccaagaaattcagtaataatccttctcattaaaaacctttctattatcttaatttattaaaagcttaattttagtttgttattttctaaagatatttgctttcaaaagtaattattcatatatatcagttacaaaattcttctactgagagttccccaccaaaataagccaggcatggtgtgcacgtgtactcccagctacttgggaggctgagatgggaggactgcttgaacctaggagttcaaaaccagcctggaaacgttagactcccaagacctt

SEQ ID NO: 376733 - DNA, 941 bp, Homo sapiens
agcctcctgagtagctgggattacaggtgtccaccaacacacccagctaatttttgtatttttagtgtagagcgggtttcaccatgttggctaggctggtctcgaactcctgacctcaggtgatccacccacctcggcctcccaaaatgttgggattacaggcgtgagccaccatgcccggccgcgagtactgttacttttaactccactagcagatttctgtttgtaaaaaagtcttcaaacaacagtaataataccaaacaattaccaagtatgctctgtgcctggcacagttgtatgcacattgcatgtgcccctctaaccctggtgtggggcagagtgtaggaacctagttcagagtcccagccattgagtcgcagagctcgtatctgagtccagcctgtctggctctgaaacccatactatactggtaactccttttcttcatcacttgcagaaaatagatctatcacacaggaggaaaagttagccaactgagacaaatcagcaaaagaagaaaatatgtctgcctttttttttattctgaaagtgataggtgttcattatagaaaaatggagtgtatacaaaactgtgtaagagagtaaataagtgttgcataagcctaccaccgcaagatgatctgttaatatttttgttgttatttccatttgagtcattttatggacttatgtaaggtacttccagtttagtattagtttacttattactactagttgatttatgccacattttttcccaaaaagctttcaaataacttacagaggcacataaaaatgtacaacctagcgtgagagcataaataagccatggtttttgtagagtgaagggaaaatttccctagaagtgccagattctgtttcatatggaagagagaataatgacatgataagtaagtagactagaatgtttatttgacatc

SEQ ID NO: 376734 - DNA, 553 bp, Homo sapiens
ttacgggggtggccacaggacataaagttttttctgatgtgttgtttgaggaggtacctgtggaatatctaagtggtgatgactgaatgaaatgtgaacacaaaaacctggaggtcagcagaaagatctgggttggagacgcagctctgagaatttactcagggaaacatctggagcagagtatgaggtaaagaaattccactgcttatctcagctgatgaaagggttaaagaagaaatgatcaacatcaatcataaagaaaagacagagttgattgaatgtccatgccacttaggtggatcacttgaagactaggagcagaaaaaaactgtagaaaattgtcttgaaaactttttatttaacagagaacacaaggtgtaatgattcagaagtaatgagtcatttagaaataataaaactattactttgcctggaaaacataggcaatcttgggtggatgactcagtgtggaaactgcttccaacagaacagtttaaaagaataccaaaagtgtacagtaaggcctatttgtggaataaaaaaggagacctgg

SEQ ID NO: 376735 - DNA, 418 bp, Homo sapiens
ttctactaaattcgcggccgcgtcgaccgaaacatctggagcagagtatgaggtaaagaaattccactgcttatctcagctgatgaaagggttaaagaagaaatgatcaacatcaatcataaagaaaagacagagttgattgaatgtccatgccacttaggtggatcacttgaagactaggagcagaaaaaaactgtagaaaattgtcttgaaaactttttatttaacagagaacacaaggtgtaatgattcagaagtaatgagtcatttagaaataataaaactattactttgcctggaaaacataggcaatcttgggtggatgactcagtgtggaaactgcttccaacagaacagtttaaaagaataccaaaagtgtacagtaaggcctatttgtggaataaaaaaggagacctgg

SEQ ID NO: 376736 - DNA, 503 bp, Homo sapiens
ttacgggggtggccacaggacataaagttttttctgatgtgttgtttgaggaggtacctgtggaatatctaagtggtgatgactgaatgaaatgtgaacacaaaaacctggaggaaacatctggagcagagtatgaggtaaagaaattccactgcttatctcagctgatgaaagggttaaagaagaaatgatcaacatcaatcataaagaaaagacagagttgattgaatgtccatgccacttaggtggatcacttgaagactaggagcagaaaaaaactgtagaaaattgtcttgaaaactttttatttaacagagaacacaaggtgtaatgattcagaagtaatgagtcatttagaaataataaaactattactttgcctggaaaacataggcaatcttgggtggatgactcagtgtggaaactgcttccaacagaacagtttaaaagaataccaaaagtgtacagtaaggcctatttgtggaataaaaaaggagacctgg

SEQ ID NO: 376737 - DNA, 638 bp, Homo sapiens
ttacgggggtggccacaggacataaagttttttctgatgtgttgtttgaggaggtacctgtggaatatctaagtggtgatgactgaatgaaatgtgaacacaaaaacctggaggaaacatctggagcagagtatgaggtaaagaaattccactgcttatctcagctgatgaaagggttaaagaagaaatgatcaacatcaatcataaagaaaagacagagttgattgaatgtccatgccacttaggtggatcacttgaagactaggagcagaaaaaaactgtagaaaattgtcttgaaaactttttatttaacagagaacacaaggtgtaatgattcagaagtaatgagtcatttagaaataataaaactattactttgcctggaaaacataggcaatcttgggtggatgactcagtgtggaaactgcttccaacagaacagtttaaaagaataccaaaagtgtacagtaaggcctatttgtggaataaaaaaggagacctggaatattttatttgtcatgtccacttcaaaaatagttgagaaatttaaaaaataaaataaataaaattaatatagttgagaaaataaaaaagtggcgtcgttggcctcaagcggtggagctcgttcccccggaagg

SEQ ID NO: 376738 - DNA, 855 bp, Homo sapiens
ttgttagaactgttgtgttcaggctgaaatactttcaaagtttgttagttattattgagaaatttctgtaataatcatggaaagggtaatttaatagttaaatctcaacttaattgaagttatttctgttgtggaacttatggtcatcttagcaagaggtcattgctttatagtcagttctctttctcattaaaaatatagtgtactcacctttacagggtgaatgttggtaaataacttctgtctgtgaaggaagtattctggacctgtaagttaaaaataaggtgtttatagcaaattatgtaaataaagattgtatattagaaggtacacactattcaaattaaagaaaatgtatattgagaaaataactcaaatttcttccatgaaattggcaagaagtaaacatttcaaatacacaaaacattatgggtatttttgttcatttgattataaaatgccaaagttgttttataaatgctacttcaagcctggaaactttgaggaagtcctgaacattaagcatataaatggcccagctctagaatacatgtaagttgaaaagctaacctgaagtgggaagcgcagtatatacctaagacttactctgcactgaaagtttgctttgtcactagaagtaaaacaagactgtggtaggatagtaagatcagtaacacctcagttaatcaggtatcttggaggaagtgaagaaagaccctaattcaagggacagttaattggccttttattccaagaatgggccttagtggcagtatcttaaaagcccacaagatggagatgtttcctaatgaaaggcctttaatttctttatagagctgagttagtgtcacatcc

SEQ ID NO: 376739 - DNA, 666 bp, Homo sapiens
ttgttagaactgttgtgttcaggctgaaatactttcaaagtttgttagttattattgagaaatttctgtaataatcatggaaagggtaatttaatagttaaatctcaacttaattgaagttatttctgttgtggaacttatggtcatcttagcaagaggtcattgctttatagtcagttctctttctcattaaaaatatagtgtactcacctttacagggtgaatgttggtaaataacttctgtctgtgaaggaagtattctggacctgtaagttaaaaataaggtgtttatagcaaattatgtaaataaagattgtatattagaaggtacacactattcaaattaaagaaaatgtatattgagaaaataactcaaatttcttccatgaaattggcaagaagtaaacatttcaaatacacaaaacattatgggtatttttgttcatttgattataaaatgccaaagttgttttataaatgctacttcaagcctggaaactttgaggaagtcctgaacattaagcatataaatggcccagctctagaatacatgtaagttgaaaagctaacctgaagtgggaagcgcagtatatacctaagacttactctgcactgaaagtttgcttgttccatttaacccgctggtgcagtaccacggtcctccat

SEQ ID NO: 376740 - DNA, 741 bp, Homo sapiens
tgcagttaaatgtttaagctgaataccaaaggaaggatgtttcaaataaatcatgccacaactaggcaggcaactacacttaaactctccattagattttaccctgaagcaaattcttagtctacttctttgtaaccatcctcatggtgctgcaagcaggacagaagacaataagggggggaattcatgatacagactgaatatgaaacgagaaactgaacccttaataatttaaaatactataggcaaaagcagacttcatgatattaaaggatatctaattccaatttgtgaaaaagacactgaatcatcagattttacattgggagcagctcttaaagattacctcattcccccaaaccccctcattctctgtctcattttgcagatgagaaacctggggtgagaggtaaagtgatctgtctgaggctctcatgtccagtgagggagctgaaactacagttcaggcctcattgctattttcactatgctttgctgtctactgtttttatttgtgtaattttaaactagatttggggtccactcttgcccctgcccccacaagccccatatcagcaatggctgatctcttaatttgagttagggagatttattacctagaaataatgacctctgtgctcttagagacccgtgactaattagaagaatgagacggggatacccaggcggatccgaacaactgcacagtgaagcccctctcgggggcgggccaagcctgtg

SEQ ID NO: 376741 - DNA, 484 bp, Homo sapiens
aattgatatttaatttgatgttggagacctaaaagtctttctgaatctagtattaattttgaattgccaccttgcctggtcagcatctttgcagttctcttcaattttataagttttgtaagtaaatatatgaagaaataaaaacattttaaattctttaatttaggtgactaatattaattgatggagcttattcatttttaaggatttttgtggttgattttcgtcatgttgcaattctagttagaatttgtataacaacatgttaatttgtattggcaattttgtatagtctgttaagtaatttaagtcaaggaaactgctaacgtgttccctcctcccttggcttttaaaaaaaagcttacaatatgtttaaatgaaatttgcataacaaattgtgtaatagatcatttgaaaagtactgttttgttacccttgagtattattcatctaaaatattaataatgaagtgctggtagttctg

SEQ ID NO: 376742 - DNA, 379 bp, Homo sapiens
tcattcaacaaacacttactgaggccaacactgggaatggagacgaacttccctgtcctcatggagcttgctttcaaaagggaaggaggcagacagtaaacaaaacaagcaagtcaatatacagcatgatgcagaaaaggtgtgatgccaccctcttgcctgagtttataacaagcagatgatgttgtcctaagaattaatttcagccggtgaaagagtacaggcaaaaaacgtggtctcggactttccggtgatgcttaagaacatagttgcagtttttgttctgattctttgtgcatctcgcgctaatgaaggattctgccatgattgccacctctggagacgtcacagccagcacagccatgaccagggatgaact

SEQ ID NO: 376743 - DNA, 428 bp, Homo sapiens
ttaaccttgccaggggattccgaagagccagggggtaagaaacactagtccaaatcaagctgtgagcactgtgcgtagctgtcttaaaatgttttctgtccccaatcctgaaactggggtaagttggttacaggtgtttccttcccttctatttggaatttaaaattctactaaaactgacaatatatactcagccttcccccacatacaccttgtccccaccaatctgtcctttaagtctgtgaggtagaaattctctccattaacatggtcatcccatttatggaatagatacattctgacaaagctgaccagaagatggaattccctatttcgacctcagtttccccactggcttcaatttaaagcagaaggtaggtggcttctggtttggagtcagaagcttcaatgagtacaccccttgagga

SEQ ID NO: 376744 - DNA, 342 bp, Homo sapiens
catttaggaagtagatgaagagagacagtaaataatccttttatttttaaaaattaaattatcttcagatcattgatagtaggtttatctaggattcaaaaatgtttctgaaaattggtcttacaaactcaaagttcgtaagactgctttttgcactgaatagtaacttgagttcacttaggtgttcctgcttctgttttaggaagaaactttgctgctttgtctttacaattaaagtatgatcttcttacattaactctctgctttacacaggaatggaatcctcagtttttgtttttgtttttacccccaaaggaggttagcagttggagttcattaaaa

SEQ ID NO: 376745 - DNA, 691 bp, Homo sapiens
gctatttactattatagtttgcacaaaggtaccctatagtctagtggtggctctgtcaaactaatattgtttcttttttgggggggtgggggatggagtctcgctctgttgccaggctggagtgcagtggcacgatcttggctcactgcaacctccacctctcgggttcaagcgattctcctgcctcagcctcccaagtagctggaattacaggtctgcaccaccaggcctggctaatttttatattttggtagagatggggtttcaccatgttggccaggctgatcttgaactcctgacctcagatgatccgcctgccttggcctcccaaagtgctgggattacaggtgtgagccaccgcgcccagcctgggaaggttattttctggcttcgagccatagtgtcttcgtctctgcctaagagatcaatgggattctcagacctcttccagccctgaaacatcatgacagctttttctgttttccccaaagtgaattcaaggctctagactgtgggccacacagctgggtactcaggactcacactaagggggaacaaggcacagagtctttgtcccatctcaatttttctcaaagatttttgagaaattttttgaaaattcaattttcaatttttaaaaatctgttaatttttgaaagaaacaaataaaacagaatttaataatatttta

SEQ ID NO: 376746 - DNA, 4737 bp, Homo sapiens
tccaggatcctacgcaccaaaccagtggagtccatgctagagggaactgggaccaccacggcacatggaactaagctagcccaggtactcaccacagtggacctcatctctcttggcgttggcagctgtgtgggcactggcatgtatgtggtctctggcctggtggccaaggaaatggcaggacctggtgtcattgtgtccttcatcattgcagccgtcgcatccatattatcaggcgtctgctatgcagagtttggagttcgagtccccaagaccacaggatctgcctacacctacagctatgtcactgttggggaatttgtggcatttttcattggctggaacctgatcctggagtacctgattggcactgcggccggagccagtgctctgagcagcatgtttgactcactagccaaccacaccatcagccgctggatggcggacagcgtgggaaccctcaatggcctggggaaaggtgaagaatcatacccagaccttctggctctgttgatcgcggtcatcgtgaccatcattgttgctctgggggtgaagaattccataggcttcaacaatgttctcaatgtgctgaacctggcagtatgggtgttcatcatgatcgcaggcctcttcttcatcaatgggaaatactgggcggagggccagttcttgccccacggctggtcaggggtgctgcaaggagcagcaacatgcttctacgctttcattggctttgacatcatcgccaccactggagaggaagccaagaatcccaacacgtccatcccttatgctatcactgcctccctggtcatctgcctgacagcatatgtgtctgtgagcgtgatcttaactctgatggtgccatattataccattgacacggaatccccactcatggagatgtttgtggctcatgggttctatgctgccaaattcgtagtggccattgggtcggttgcaggactgacagtcagcttgctggggtccctcttcccgatgccgagggtcatttatgccatggctggtgacgggctccttttcaggttcctggctcacgtcagctcctacacagagacaccagtggtggcctgcatcgtgtcggggttcctggcagcgctcctcgcactgttggtcagcttgagagacctgatagagatgatgtctatcggcacgctcctggcctacaccttggtctctgtctgtgtcttgctccttcgataccaacctgagagtgacattgatggttttgtcaagttcttgtctgaggagcacaccaagaagaaggagggcattctggctgactgtgagaaggaagcttgttctcctgtgagtgagggggatgagttttctggcccagccaccaacacatgtggggccaagaacttaccatccttgggagacaatgagatgctcatagggaaatcagacaagtcaacctacaacgtcaaccaccccaattacggcaccgtggacatgaccacaggcatagaagctgatgaatccgaaaatatttatctcatcaagttaaagaagctgattgggcctcattattacaccatgagaatccggctgggccttccaggcaaaatggaccggcccacagcagcgacggggcacacggtgaccatctgcgtgctcctgctcttcatcctcatgttcatcttctgctccttcatcatctttggttctgactacatctcagagcagagctggtgggccatccttctggttgttctgatggtgctgctgatcagcaccctggtgtttgtgatcctgcagcagccagagaaccccaagaagctgccctacatggccccttgcctcccctttgtgcctgcctttgccatgctggtgaacatctatctcatgctaaagctctccaccatcacatggatccggtttgcggtctggtgctttgtgggtctgctcatttattttggatatggcatctggaacagcaccctggaaatcagcgctcgagaagaggccctgcaccaaagcacgtaccaacgctacgacgtggatgaccccttctcagtggaggagggtttctcctacgccacagagggcgagagccaggaggactggggcgggcccactgaagacaaaggcttctattaccaacagatgtcagatgcgaaggcaaacggccggacaagtagcaaagcgaagagcaaaagcaaacacaaacagaactcagaggccctgattgcaaatgatgagttagattactctccagagtaggagaaacacacaagtgggtagaaatggtgatgactgattttcagtaacttaacctgtgggctagaaggtgaaaacttttttggctctcatttcacaaatccagccttccccaaattcaatccctagtcatagcctgtcatttgctacttttgctcttcaggatagttctgttgaagggcttaacctgggtcccctaactggtcgccttgttaaataaaataaataaataaacaagaggctatatgaaattccatcttaggtgcaaccaccagagctgatggtaccaaatgtttcctaggcctttgctttgctggttgaagcccaagcaggggctctgggcagaaggcagaatttcagtcacctgagacatggggacaaagctctgttcttggcatgtcaggctgagtgctgctccccgaggtcagggtgggtagatgggcattggcacttcctgagcaagcatcattttatcctgcaatctcacccaaaattaattcatggaaaagacacatgcttctttttattcaccaacattctcacagcttccaaactataattttaggatccagcaaagttcagggactctggaccattttcccaatggtttcagattcaccataaagcagtcaggcagacccagtgatatggtaagaagcaccatcaaagctctatgtaaatgcccagaagaaaattaaataaccatatcttgcggtaaaagccagaagggcattggcagaaattaactctctgtcatggcctctcttatatcagactgcagctcctggtgatatgatgaaagcgggcaaaggtggagcatgatttcatggcactgatatgccttgaaaaagtaggttgtttgttttataatcagataaaaatttttacaaggagaagtgagccagccactgagatcacattgcaaattctctttcatatttctaaaattataaattctaaagtttttgagataggcaaccacttgattggtgtgtgctactctgaaaacaaaataggctgaagtatagcgacttaggtagttgcattccatgagatcacatttcacttctgaaccttattccttggggctagctcactttcagaggtgtatttttttttcctgttatttcccagagtagtttcactgaagcccagagaaatatctacctggtaagatgtaaatttgggccataaaaggggctattaaaagaattttctcagaaatagaatagatgagagaatttgcaaaggaaaaaaacacacatgggctacaatataaattctactcttgggttacaagaattcctgtggctgcactgagatacgtacaaatgtatgtgaaggcacaatttgaatcaagctatcatagaattaaccaagctattaaaattaatcaagctattaataaaatctctgtgaggatttcctgaaagagggacaaaagaagaaattccttgtcctttctctcctggatgtatcagtatgccaaacgttttccagaacatattcgctagcactcaagtctgttctttctgaaaggctgaggctcatgccatcttggcatgctttaggattatggcaaggaggtaaaagtccattttttcattcaactaacactggttgagaatagacccaatgctaagtgacaggaatgaatagaagcatggcacttgcccttgggggctacagtccatggatgagcagcactggagcctggtaaatgcagataaaacaacaaacttgacaagtctccaggctgatgcactgggttttaacatacatataaagatgaattgaaactagtttttaaaaaatatgctttaaataaattacatatcgtaatcatagccaatgtataccattaaactaaaataactgcaattttctagatattttttattcttctgtagtcattgtttagaactctggtttcctgaggtcattttgtcattttaatatcatgcttgacaatgctatgttttctcttccctagagttaaccataaagatacagtgcctactctgtgaaatacagcattaggaattaattataaactaattatcagtcatcttttgaaaacaaagttttgaattggctataggactcaacaaatctgcctggtgtaaatagaatctgttaagcttgatacatatctagatagatgaggaggggttgtattcattaagcatgagaatagagaaataggagtgcaaaatggcaaaatcttaacgtgggtgaaagagcttccttttactagtgaggtttaagtattaaagtaacaatagcctggtggcagatgaatgcaatttctataggatgggaatggaaaatgtatgctttggttaacaccattgctgttgacttcatgcagattctattaagcactctcatttcaggagccatttttcccacatagtatattagtatattttaagcttagctccctttatttttctaaagttgataaatcacctccctagcaaccttagtttt

SEQ ID NO: 376747 - DNA, 4308 bp, Homo sapiens
tccaggatcctacgcaccaaaccagtggagtccatgctagagggaactgggaccaccacggcacatggaactaagctagcccaggtactcaccacagtggacctcatctctcttggcgttggcagctgtgtgggcactggcatgtatgtggtctctggcctggtggccaaggaaatggcaggacctggtgtcattgtgtccttcatcattgcagccgtcgcatccatattatcaggcgtctgctatgcagagtttggagttcgagtccccaagaccacaggatctgcctacacctacagctatgtcactgttggggaatttgtggcatttttcattggctggaacctgatcctggagtacctgattggcactgcggccggagccagtgctctgagcagcatgtttgactcactagccaaccacaccatcagccgctggatggcggacagcgtgggaaccctcaatggcctggggaaaggtgaagaatcatacccagaccttctggctctgttgatcgcggtcatcgtgaccatcattgttgctctgggggtgaagaattccataggcttcaacaatgttctcaatgtgctgaacctggcagtatgggtgttcatcatgatcgcaggcctcttcttcatcaatgggaaatactgggcggagggccagttcttgccccacggctggtcaggggtgctgcaaggagcagcaacatgcttctacgctttcattggctttgacatcatcgccaccactggagaggaagccaagaatcccaacacgtccatcccttatgctatcactgcctccctggtcatctgcctgacagcatatgtgtctgtgagcgtgatcttaactctgatggtgccatattataccattgacacggaatccccactcatggagatgtttgtggctcatgggttctatgctgccaaattcgtagtggccattgggtcggttgcaggactgacagtcagcttgctggggtccctcttcccgatgccgagggtcatttatgccatggctggtgacgggctccttttcaggttcctggctcacgtcagctcctacacagagacaccagtggtggcctgcatcgtgtcggggttcctggcagcgctcctcgcactgttggtcagcttgagagacctgatagagatgatgtctatcggcacgctcctggcctacaccttggtctctgtctgtgtcttgctccttcgataccaacctgagagtgacattgatggttttgtcaagttcttgtctgaggagcacaccaagaagaaggagggcattctggctgactgtgagaaggaagcttgttctcctgtgagtgagggggatgagttttctggcccagccaccaacacatgtggggccaagaacttaccatccttgggagacaatgagatgctcatagggaaatcagacaagtcaacctacaacgtcaaccaccccaattacggcaccgtggacatgaccacaggcatagaagctgatgaatccgaaaatatttatctcatcaagttaaagaagctgattgggcctcattattacaccatgagaatccggctgggccttccaggcaaaatggaccggcccacagcagcgacggggcacacggtgaccatctgcgtgctcctgctcttcatcctcatgttcatcttctgctccttcatcatctttggttctgactacatctcagagcagagctggtgggccatccttctggttgttctgatggtgctgctgatcagcaccctggtgtttgtgatcctgcagcagccagagaaccccaagaagctgccctacatggccccttgcctcccctttgtgcctgcctttgccatgctggtgaacatctatctcatgctaaagctctccaccatcacatggatccggtttgcggtctggtgctttgtgggtctgctcatttattttggatatggcatctggaacagcaccctggaaatcagcgctcgagaagaggccctgcaccaaagcacgtaccaacgctacgacgtggatgaccccttctcagtggaggagggtttctcctacgccacagagggcgagagccaggaggactggggcgggcccactgaagacaaaggcttctattaccaacagatgtcagatgcgaaggcaaacggccggacaagtagcaaagcgaagagcaaaagcaaacacaaacagaactcagaggccctgattgcaaatgatgagttagattactctccagagtaggagaaacacacaagtgggtagaaatggtgatgactgattttcagtaacttaacctgtgggctagaaggtgaaaacttttttggctctcatttcacaaatccagccttccccaaattcaatccctagtcatagcctgtcatttgctacttttgctcttcaggatagttctgttgaagggcttaacctgggtcccctaactggtcgccttgttaaataaaataaataaataaacaagaggctatatgaaattccatcttaggtgcaaccaccagagctgatggtaccaaatgtttcctaggcctttgctttgctggttgaagcccaagcaggggctctgggcagaaggcagaatttcagtcacctgagacatggggacaaagctctgttcttggcatgtcaggctgagtgctgctccccgaggtcagggtgggtagatgggcattggcacttcctgagcaagcatcattttatcctgcaatctcacccaaaattaattcatggaaaagacacatgcttctttttattcaccaacattctcacagcttccaaactataattttaggatccagcaaagttcagggactctggaccattttcccaatggtttcagattcaccataaagcagtcaggcagacccagtgatatggtaagaagcaccatcaaagctctatgtaaatgcccagaagaaaattaaataaccatatcttgcggtaaaagccagaagggcattggcagaaattaactctctgtcatggcctctcttatatcagactgcagctcctggtgatatgatgaaagcgggcaaaggtggagcatgatttcatggcactgatatgccttgaaaaagtaggttgtttgttttataatcagataaaaatttttacaaggagaagtgagccagccactgagatcacattgcaaattctctttcatatttctaaaattataaattctaaagtttttgagataggcaaccacttgattggtgtgtgctactctgaaaacaaaataggctgaagtatagcgacttaggtagttgcattccatgagatcacatttcacttctgaaccttattccttggggctagctcactttcagaggtgtatttttttttcctgttatttcccagagtagtttcactgaagcccagagaaatatctacctggtaagatgtaaatttgggccataaaaggggctattaaaagaattttctcagaaatagaatagatgagagaatttgcaaaggaaaaaaacacacatgggctacaatataaattctactcttgggttacaagaattcctgtggctgcactgagatacgtacaaatgtatgtgaaggcacaatttgaatcaagctatcatagaattaaccaagctattaaaattaatcaagctattaataaaatctctgtgaggatttcctgaaagagggacaaaagaagaaattccttgtcctttctctcctggatgtatcagtatgccaaacgttttccagaacatattcgctagcactcaagtctgttctttctgaaaggctgaggctcatgccatcttggcatgctttaggattatggcaaggaggtaaaagtccattttttcattcaactaacactggttgagaatagacccaatgctaagtgacaggaatgaatagaagcatggcacttgcccttgggggctacagtccatggatgagcagcactggagcctggtaaatgcagataaaacaacaaacttgacaagtctccaggctgatgcactgggttttaacatacatataaagatgaattgaaactagtttttaaaaaatatgctttaaataaattacatatcgtaatcatagccaatgtataccattaaactaaaataactgcaattttctagatattttttattcttctgtagtcattgtttagaactctggtttcctgaggaccattgggcctctagaatcagggtggaacaggcatgtttctcctccccaaattacccaaaaataagggcaactcgggaaaaaacacggaataattacaacaggcctttggaatgcgagagcgcc

SEQ ID NO: 376748 - DNA, 429 bp, Homo sapiens
gcttctgccttcacaggttttgctgctctgagaacccccagctaatgtgtgactggcacatccagcttagtgtcatacttccagacacccagagcccacgagcctggccctgaaaagaggggcaggaccccaggagagggtcctgatcctctgccttcacactctgagaagccagctttgttttaaaggtagtcatggggggagaatttcccgaagcccctaacgatgctctccagggagctcagagaggtttctgagaaatgcgtgggcaggggctgtgtatactactccagcctctacacagccacccccaatgcagagacaccacaggcagacatgcagtcacacacatctgcacactcactaacactgccatctctctgcctccctcgattctgcccttcctccctctttccctttccctctttc

SEQ ID NO: 376749 - DNA, 379 bp, Homo sapiens
  misc_feature (147)..(147): n is a, c, g, or t
  misc_feature (329)..(329): n is a, c, g, or t
  misc_feature (338)..(338): n is a, c, g, or t
gagctgaaaaattcctgtcacctagtgactttctagccaatataacactgtagcacaataccattactcatgtgtttgcagtgatgctgccgtaaacaaacctactctgctgctcagtgcatccttggcggtccagcaggccagggntgggtgaccgatggcttcagttccctgaaagactactaggagcaccgttaaggacaagttctctgagttctgggatttggaccctgaggtcagaccaacttcagccgtggtgcctgagacctcaataccccaagtccacctgcctatccatcctgccagctccttgggtcctgcaatcttcnagggctgcncctgtaaggttgcttaaaagggacaagtaattctcaagtgg

SEQ ID NO: 376750 - DNA, 424 bp, Homo sapiens
cagagactgatattagagcgcatcttacagctacaagccaaggaacgccaagaattgccagccagtaccagaagctgggacagacgcccaggacagagtctccctcagatcctgcagaaggaagccacgctgcagcaccttactgaaacacagcatttctttctattccaaatggagagaatacaccagagtggtatgagcagttacctgtgactttgtcactaaccaaaattacagatatctctgggtgcggtggctcatgtctgtaatcccagcactttgggaggccgaggcgggtggatcacctgaagtcagcagttcgagaccagcttggccaacatggtgaaaccccgtctctactaaaaatacaaaaattagccaaatgtggtggcgggcgcctgtaatcccagctactcaagagtcc

SEQ ID NO: 376751 - DNA, 350 bp, Homo sapiens
aaagaataaagcttctatagttcattcttttgatttatttttactgaaaatgagaatttagcactttttgtaccctcttgtcatcctccatataaaacttgtgatatataaacacaaatgtataaggtagtgtcatatataaataatatataataaattttatatagtaactcagttttaaaaaaatcagtatattcattctttgtaagaatcaggtaactgattatattgccttttttatattacctattgagtgtttttttctttggtaatttatttttaactagctacttttctgtatttataatccaccagttgatttttcttttcttagatatcttcttgaagcc

SEQ ID NO: 376752 - DNA, 365 bp, Homo sapiens
tttttttttgtagagacgtggttttgccatgttgcccaggctggtctcaaactcctgagctcaagtgatctacctgtctcaacctcccaaagtgctgagattacaagcatgagctaacgcgccaggcctcttttcttcctaacagccaaatgaatactactgaggtaggaaacctgtaggacttatttgccggtcccaacagaatgaaatgaaaaaaccagcaggaaccagcagatggcatcaaaagtgacctctagttgcccttgctgttcattggcataagacactcctaccagtgccatgacagtttacaaagaccatggcaacacccggaagttactgccccctttctagagatttctgaa

SEQ ID NO: 376753 - DNA, 275 bp, Homo sapiens
ctgcaaacattgataaattatttatccctactaagcctctggttctttataaaataaaaattataataatgatattaaacttctcacctaagaagttcattataagaaggaattagaagtatctataattatatttaggcatatctttggatataggtgtatttattttgtaaatgtcaagtttctcttctgccaaatggaatggctttcctgttaaggaactacattttcatctattttagtatttaagtagacctctattaggaaatattatt

SEQ ID NO: 376754 - DNA, 604 bp, Homo sapiens
catacctcttctcatctcttctgttccctgtggcttcaaaacatgtctcggagggtggcttggagaaaaaacaactctccagtacaaaacccttgggctggttaggattcagagaggaacacatggggaataagcccattcttcatgctctggggccttcccaggttttaggagtggtgtctttctttctcctgctcataagggtattgggcggtttccaagcctggtttgtatttcatcttcaattctaggattgtcgtccagatgtcaaaggtggcgtcctggtgtctcctgggcagaaagtccgaatgccaaagtggccttcttatcactctggggtctctcaatgacagctgtgtctggcctaccagatttgagcaaaccttgtcatctgtttcattatctgctgtattaaaattttttaatggcatttagatgttaaattctgaaacgctttcctctcatctttgaatgtataaaaaagctggagtacttcaagtacagacgaatcatctgaatgttcagcaccactggacttctgccagtggccgaggaagggaccatagcctcgtgtttccccctctacctctggatgattacagac

SEQ ID NO: 376755 - DNA, 360 bp, Homo sapiens
ggcatccctctgttgccttgactacggcgggcgctgtgggagtggagaagctgcaagtgctgaggcgcggtggaggaaagcatgggagccaagagtatgaggagctggtgtctgtgtcagatttgtagctgcggaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctcaaaaaaaaa

SEQ ID NO: 376756 - DNA, 440 bp, Homo sapiens
ggcatccctctgttgccttgactacggcgggcgctgtgggagtggagaagctgcaagtgctgaggcgcggtggaggaaagcatgggagccaagagtatgaggagctggtgtctgtgtcagatttgtagctgcggctttctgtcctcccagccagaccatattcccattcccgtccaggcagcagttctttgggatccgcctgactgaaaagtcaaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctcaaaaaaaaa

SEQ ID NO: 376757 - DNA, 490 bp, Homo sapiens
ggcatccctctgttgccttgactacggcgggcgctgtgggagtggagaagctgcaagtgctgaggcgcggtggaggaaagcatgggagccaagagtatgaggagctggtgtctgtgtcagatttgtagctgcggcccctgagactcccaatcaaggatgcaaagtaaaatgccacccgggccagctttctgtcctcccagccagaccatattcccattcccgtccaggcagcagttctttgggatccgcctgactgaaaagtcaaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctcaaaaaaaaa

SEQ ID NO: 376758 - DNA, 356 bp, Homo sapiens
ttgtggataacgtaatctcctctggttagtctaggcaaaaaggaatttattaaggagtatatatatagttcacttggaagaacttaagaaatcattttcaaaataagcttccacaaaaattttaccacagaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctcaaaaaaaaa

SEQ ID NO: 376759 - DNA, 287 bp, Homo sapiens
atggctcgtaattatagttggcagtagggatcgagtgaagatgtttgctgtatacgtattgaggcaatttagagaaagaaattatcccttgtcgatgaagaatcagtaggcccagttggaaattacaataattttttcccataataatgttcttcatatgattatttacatgtgatatagttcatatttcagtgaaagctcatttttctcttcctgacttaggctatcttacaagttgaccttgagtttttgaaaatcactgtgtaactgtggaatatttgctttca

SEQ ID NO: 376760 - DNA, 775 bp, Homo sapiens
ggctcccaatccagagctgttgggtggagaagcagctactctggtcacacgtgggaggcggggggagggggtcttgggcctaaaatagcggtgaagagattgtgatagctcgtgtcagaggggcatgcagagctactggagggcttctcctttctgcagcttctctgtggttttctctgcagctttccttccctgtgctaagcagatccctctccacaactcttacctcaacccgcagacttgaagaccttgatgtcatctcatccatttaccctggtagtgaaaaatcacagattttgagtttgggagaaacccttttccaataaccgaaatgtgtaattggattggtcctttttgcatttcctttcctcttagatggttttatggtcttggtctatctcacttaatggtgaggaagcttcaaggtcagtggtttttacaaaagtagacatcgtatttatagacctcatgtggatgttactaaattggaggcttctctccaaggtgggaatcgttttgggagcggggggcggtggttaactttgtttctggccacagttagtccggcttttatttcataatttgtgtgatttttttttttactctcacatctcatttgattttagcaacaatcctatagctaaggtttatagatgactcattatgacagtcactggccttggccttttatatgggttatctaatataatcttcacccattctcaagaggtggctactgttttttcctgcccctgaaccctttaacaacaacaac

SEQ ID NO: 376761 - DNA, 375 bp, Homo sapiens
gctgaccatcaatgctttccacattgtattcattgccagtcacctccacttggccttcatagatcttgtccatgcctaacctattgagaagcctgcgggccagcagcaggccagtacaatacgctgcagcataatttgtcaggccggccttcacaccatattttgtgcagactatcatagccccctctatacgggcataagcaacctgacaaatgatatctctatcatcctgtatttgggtgtgttgtatttatttttatactgtatcaccaagcatttctgagcatagtaatcagttttaccctttcatcatcttctaaatttcacttggtaactcttaaagtaggccttattcttaacaattttaacaaaccc

SEQ ID NO: 376762 - DNA, 399 bp, Homo sapiens
aagtgctgtgtagtgttcctaagtgcagaaaggttgtggtgtgacttagagagaaaatgcatgcattagataagcttccctcaggcgtgagttacaataagaacatggcactaaatagaatgtgaaaaggacacttgtttacagtgtgagaggagcaaaaaagaaggcagatcatctcctgttggttagacctcagctgggtaatttaaaattttactggctctgcatatgtcatgaatgactgtgaaagcaccctaagtaatgattttgaagtaacaaaaatatggaaaatgttacaattcagagggttataaatttaagataatatgtatataaattgcctagctcagagtagattactaatagtaatttggatttaaaaatatatccttaattata

SEQ ID NO: 376763 - DNA, 333 bp, Homo sapiens
ggtttctagctatttttatcttagttttgcttttattaatatttttatttgacacataatgattgtacatattaatggtgtacagaatgatattttgatacctgtatacaatgtataataaatcagggtaattattatattcatcacctcaaatatttatcatttcttgctgttgggaacatacaaaatttgttctttatagctatttgaaaatatacgataaattattgttaattatagtcaccctatagtgctatagaacacaaaaactgattccttaatctagctgtaattttgtattcattaaccaacttctggcaatgctcttccctc

SEQ ID NO: 376764 - DNA, 976 bp, Homo sapiens
gatgtgaaggaaaaatacagaccaagaatatatcttcagaaaattctaatctgtgctgggtagttaggggaaggctaagaggtttgagataatctctgagcaggtacaggagacaaagaaatggatagggatggattggtatggaaaggtattgcaggccaacagcattatgtaaatcttggtcaagagccagcataatggatttgaggaagtggaaagaagggaggttagtgtggcaggaggactgcctgggagccaggtctcagaagaggctagagagtgaggtaagggttttactcgaacttcatgtcctggctagagactcatgtttaattcaagccaaacagtttccagattccatgccagttttctacttcacctgttttttttgttaactgtggttaaaaaaaaaaatatatatatatatatatgcaaaatacagaatttactgtcttaagcattttaagtgtttgcagacagtccccagcttaacaatggtttaacttacgattcttttgactttccaccagtgcaaaagcaatacatatttagtataaaccggacattgagtatccatacaacccattttgttttttactttcagtatagtattcaaaaattacatgagattgtaattattatctcacttatttcacattatcaacactttattaaaaaataggctttatgttagatgattttgcccaactgtagactaatgtaaatgttctgagcatgttgaaggtagtgtaaaccaaaaataaaattctaagcacctctcccccaaccccccaactatctcaatggactttctcagccagggcgcttttaaaatgtaacctgagagactgattcaggccataaggggaagtgggtgttggacatgcctcattatacctctctggcattaacgtcaacacagaccttaaagtctaataagaaacatgtaccctaaaacttaaagtataataataat

SEQ ID NO: 376765 - DNA, 661 bp, Homo sapiens
tcaacttttccttctgtattagcaccagtagggtagaatagtgcggggaagtgttacaatgaggcttcccacttaggtgaggggagacaggagctcctttagagaagggctataagtttttaaaggatgtggaaatgggatgtgtttcctgttgccttgaaatggaggaaaagcctcaaagctaaaactaggagacaggttggttccttcaaaccaaaggaagccaacttcctgatttcttacacatggacaagagttttcctttatataaactcctatgttccattgaaaccaacccaataatcccatagactgttctttttgatacacatagaaattgacctttctgttcttaaagcttgaagcttacatttgttttatctgagttccttcctcaggaaagcaccttcaggcctcttaaaaaggtatccaagaagtgaaactcaccagatcatgacatcctaacaatgagaagcctggagccctcattcatcatgattgcatccttgcctctccctagttcctgtttcttacacattgttacatttctttctacagaagaatgttatataaacccataggtttagtcagttagagagatggatttgagcctgagctctcatctccttgactgcagcacctgattaaagacttcttcctt

SEQ ID NO: 376766 - DNA, 614 bp, Homo sapiens
aataccttttgctggtcttgttagtactataccaaaaacctcaagaaggcagttttcaggttggtcacatttctgccatttgctttttcaaatcaagttggcaaaaatagcattatcaaaacagtgaccttctgtaacagcctactgggtaagatcatgtatgaactccagagtcagactcttgtgggttagaacccagacttttgctagttcatcagctctctggctttagagagagctcttcactccccagttaggtttctgtatctataaggtggacatgatagtagcagggcctaccctcataggattgttatgaaggttaaattaggtaacacacaaaaagttctctactcagtgctctcacagaataagcattcaataaatgctattgatgctattgttacattgttgttaagccaaaaaaagtatggcacatctcttattatagtagttataaattaaaatgttcttttagccagtattacagctgtcatttcattttcttcccagtttccattgcttcctctgggtctgtttctatccattcacttaaaaaataaataaaatgaaatattgagcatatcttcttcagttctctctcacgccctgcc

SEQ ID NO: 376767 - DNA, 390 bp, Homo sapiens
attcatggcattttatgtcttgagattataaaaattttatttttaaaatatcctaaaggatacaaataaacgtcattgttttagtttttggtaaaactgtagaatacaaacaataatttaatagaaaaatgacttccagagtgtattggcaagaaaaaaatttttttaaataaccatttaaagtctctgccagttgtcctaagggaatatagcaaatgaagaaatgataaggaaagtttactaaatctccataagaacattgagtctgtggcatttaggctacaatccatttctccctaaccaaacccctgccccaactcaatgctatagaagctctactctgaggctccactcagtcttcttggatatggtcaagaagatcgtactcct

SEQ ID NO: 376768 - DNA, 5617 bp, Homo sapiens
agccggaagtcgcgagatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtgggtatattcgcctcattcaaatggcagtagccttggctcacataagacatgtttcatgtgatctgtatcctggcataccagttatattttgtggggactttaatagtacaccatcaacaggaatgtttcattttgtcatcaatggcagcattcccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaacttgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcatgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgttattgcttctcatctttcatttttcaatgaacaagtaaggtattttcattcttatttttaggattttagtttttagtgtatggtacaaatgaacacagtttatattctaattcttactgcagctcattttaatttttaggatgcaagcacaatttagtattcaaagtgagtagcaacatattcaacttgatcccattgtcttcagttactcttgcccatgaaaaatgttcataaatgaacagggtatttgaccatatgatattagaaaatacagcacattactttatgagaaactacctactgatatgggcttgaaattttggatgaatcattgagcatttctacactagaagtaatttcaaaattgttggtttttataaacaggaaaaaggttgagtagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgtttagaaaaaactataaataaaaaattgatgctaccaaattgtgccttcctaaataacatttttgagagcattttaacagcagtttacaaatatgtaaataatagattaaaaccaaatcttgattctcttgtgaatttttttttcattttaaaaatatgtttttgggctgttttcaaagaaagatgttgatagaacccttagagtgacttgggagaaaacaaagtgtcacatcaaaaagttgagaaacattttgaaagaaaaaattcgaacatgcccatgaaaaaagcatacagcttccacattaacactggctagattaaactctagtcagaaaaactcagcacttaacagacattccatgtcctatatccttaattttgatgttttctgactaaacaatatactcagattgtatacaggcatttcacattattaggacatggaatgttattgtgaagtgccatatactgtgatcaaatctccagtatacggatacgttaaaatgattggagtccaaaggtagggaacactaagaaaatgtataaatagcatacacatttctttgtactcatgagttagaatgcagtgttattcagaaatgtctgtttaaagcacctatgtgattgcatttttctattacatttggattttttagtacatttaattttaagaaaacatgggaaatctagcgactttctatggtaaaccacattttataatgtcacaagttcttgctataggaattaacattctagaattttatattgattataaaagagtatttcagaacatattattctgttaaaatgaactcttgcacagttgccgctacagcaaatgtgtctgccaataatcaaaattcatgagcaaacaatcgtttctggctgtaatgtatgttctttttgaaattctgtatgctaaaatcagttgtttcaaaatttcaagaattccactgagtagtgatttttctgagtactaagctatgatctcatcagaatgtgctggtttcagtctggagatagatttctgaggagcctaatacaagggagagaatgtccaaagaacactactgtggaaagttcttacgatggaaattgacatcttttgtatctcattctccagccgtgaaataaaggcagaggttccctgcaaactagtttggttgggataaatccaatatttatatataatgaaaaataaaagtttgcattattagtttatcacaagacccatgtgacaactcagaaaatattctcagcataatttttttaagagatagggtctcactgttacccaggctggagtgcagtggtgcagtcataacttactacagcctcaaactgcggggctcaaatgatcctcctgcctcagcgtcccaagtagttgagattacaagcccaaccttccataactgaaaactaactttctttttttctttttttattattatactttaagttctagtgtacatgtgcccaacgtgcagatttgttacataggtatacatgtgccatgttggtttgctgcacccgttaactcgtcatttacattaggtatttctcctaatgctatccctcccccagccctgaaaatgaattttttaaacacaaataaaaaatatttcagtgttttgagaattttaataatttgcttaatatagtacaggaaggcaacactatctagagggccaggcatagtggctcttgactgtaatcacaacattttgggaggctgaggcaggaggatcacctgag

SEQ ID NO: 376769 - DNA, 5014 bp, Homo sapiens
agccggaagtcgcgagatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtgggtatattcgcctcattcaaatggcagtagccttggctcacataagacatgtttcatgtgatctgtatcctggcataccagttatattttgtggggactttaatagtacaccatcaacaggaatgtttcattttgtcatcaatggcagcattcccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaacttgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcatgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgttattgcttctcatctttcatttttcaatgaacaagtaaggtattttcattcttatttttaggattttagtttttagtgtatggtacaaatgaacacagtttatattctaattcttactgcagctcattttaatttttaggatgcaagcacaatttagtattcaaagtgagtagcaacatattcaacttgatcccattgtcttcagttactcttgcccatgaaaaatgttcataaatgaacagggtatttgaccatatgatattagaaaatacagcacattactttatgagaaactacctactgatatgggcttgaaattttggatgaatcattgagcatttctacactagaagtaatttcaaaattgttggtttttataaacaggaaaaaggttgagtagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgtttagaaaaaactataaataaaaaattgatgctaccaaattgtgccttcctaaataacatttttgagagcattttaacagcagtttacaaatatgtaaataatagattaaaaccaaatcttgattctcttgtgaatttttttttcattttaaaaatatgtttttgggctgttttcaaagaaagatgttgatagaacccttagagtgacttgggagaaaacaaagtgtcacatcaaaaagttgagaaacattttgaaagaaaaaattcgaacatgcccatgaaaaaagcatacagcttccacattaacactggctagattaaactctagtcagaaaaactcagcacttaacagacattccatgtcctatatccttaattttgatgttttctgactaaacaatatactcagattgtatacaggcatttcacattattaggacatggaatgttattgtgaagtgccatatactgtgatcaaatctccagtatacggatacgttaaaatgattggagtccaaaggtagggaacactaagaaaatgtataaatagcatacacatttctttgtactcatgagttagaatgcagtgttattcagaaatgtctgtttaaagcacctatgtgattgcatttttctattacatttggattttttagtacatttaattttaagaaaacatgggaaatctagcgactttctatggtaaaccacattttataatgtcacaagttcttgctataggaattaacattctagaattttatattgattataaaagagtatttcagaacatattattctgttaaaatgaactcttgcacagttgccgctacagcaaatgtgtctgccaataatcaaaattcatgagcaaacaatcgtttctggctgtaatgtatgttctttttgaaattctgtatgctaaaatcagttgtttcaaaatttcaagaattccactgagtagtgatttttctgagtactaagctatgatctcatcagaatgtgctggtttcagtctggagatagatttctgaggagcctaatacaagggagagaatgtccaaagaacactactgtggaaagttcttacgatggaaattgacatcttttgtatctcattctccagccgtgaaataaaggcagaggttccctgca

SEQ ID NO: 376770 - DNA, 3977 bp, Homo sapiens
agccggaagtcgcgagatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtgggtatattcgcctcattcaaatggcagtagccttggctcacataagacatgtttcatgtgatctgtatcctggcataccagttatattttgtggggactttaatagtacaccatcaacaggaatgtttcattttgtcatcaatggcagcattcccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaacttgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcatgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgttattgcttctcatctttcatttttcaatgaacaagtaaggtattttcattcttatttttaggattttagtttttagtgtatggtacaaatgaacacagtttatattctaattcttactgcagctcattttaatttttaggatgcaagcacaatttagtattcaaagtgagtagcaacatattcaacttgatcccattgtcttcagttactcttgcccatgaaaaatgttcataaatgaacagggtatttgaccatatgatattagaaaatacagcacattactttatgagaaactacctactgatatgggcttgaaattttggatgaatcattgagcatttctacactagaagtaatttcaaaattgttggtttttataaacaggaaaaaggttgagtagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgtttagaaaaaactataaataaaaaattgatgctaccaaattgtgccttcctaaataacatttttgagagcattttaacagcagtttacaaatatgtaaataatagattaaaacca

SEQ ID NO: 376771 - DNA, 5491 bp, Homo sapiens
agccggaagtcgcgagatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtgggtatattcgcctcattcaaatggcagtagccttggctcacataagacatgtttcatgtgatctgtatcctggcataccagttatattttgtggggactttaatagtacaccatcaacaggaatgtttcattttgtcatcaatggcagcattcccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaacttgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcatgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgttattgcttctcatctttcatttttcaatgaacaagtaaggtattttcattcttatttttaggattttagtttttagtgtatggtacaaatgaacacagtttatattctaattcttactgcagctcattttaatttttaggatgcaagcacaatttagtattcaaagtgagtagcaacatattcaacttgatcccattgtcttcagttactcttgcccatgaaaaatgttcataaatgaacagggtatttgaccatatgatattagaaaatacagcacattactttatgagaaactacctactgatatgggcttgaaattttggatgaatcattgagcatttctacactagaagtaatttcaaaattgttggtttttataaacaggaaaaaggttgagtagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgtttagaaaaaactataaataaaaaattgatgctaccaaattgtgccttcctaaataacatttttgagagcattttaacagcagtttacaaatatgtaaataatagattaaaaccaaatcttgattctcttgtgaatttttttttcattttaaaaatatgtttttgggctgttttcaaagaaagatgttgatagaacccttagagtgacttgggagaaaacaaagtgtcacatcaaaaagttgagaaacattttgaaagaaaaaattcgaacatgcccatgaaaaaagcatacagcttccacattaacactggctagattaaactctagtcagaaaaactcagcacttaacagacattccatgtcctatatccttaattttgatgttttctgactaaacaatatactcagattgtatacaggcatttcacattattaggacatggaatgttattgtgaagtgccatatactgtgatcaaatctccagtatacggatacgttaaaatgattggagtccaaaggtagggaacactaagaaaatgtataaatagcatacacatttctttgtactcatgagttagaatgcagtgttattcagaaatgtctgtttaaagcacctatgtgattgcatttttctattacatttggattttttagtacatttaattttaagaaaacatgggaaatctagcgactttctatggtaaaccacattttataatgtcacaagttcttgctataggaattaacattctagaattttatattgattataaaagagtatttcagaacatattattctgttaaaatgaactcttgcacagttgccgctacagcaaatgtgtctgccaataatcaaaattcatgagcaaacaatcgtttctggctgtaatgtatgttctttttgaaattctgtatgctaaaatcagttgtttcaaaatttcaagaattccactgagtagtgatttttctgagtactaagctatgatctcatcagaatgtgctggtttcagtctggagatagatttctgaggagcctaatacaagggagagaatgtccaaagaacactactgtggaaagttcttacgatggaaattgacatcttttgtatctcattctccagccgtgaaataaaggcagaggttccctgcaaactagtttggttgggataaatccaatatttatatataatgaaaaataaaagtttgcattattagtttatcacaagacccatgtgacaactcagaaaatattctcagcataatttttttaagagatagggtctcactgttacccaggctggagtgcagtggtgcagtcataacttactacagcctcaaactgcggggctcaaatgatcctcctgcctcagcgtcccaagtagttgagattacaagcccaaccttccataactgaaaactaactttctttttttctttttttattattatactttaagttctagtgtacatgtgcccaacgtgcagatttgttacataggtatacatgtgccatgttggtttgctgcacccgttaactcgtcatttacattaggtatttctcctaatgctatccctcccccagccctgaaaatgaattttttaaacacaaataaaaaatatttcagtg

SEQ ID NO: 376772 - DNA, 5353 bp, Homo sapiens
agccggaagtcgcgagatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtgggtatattcgcctcattcaaatggcagtagccttggctcacataagacatgtttcatgtgatctgtatcctggcataccagttatattttgtggggactttaatagtacaccatcaacaggaatgtttcattttgtcatcaatggcagcattcccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaacttgagactctcagaaaaggaagattgaattagcgtgttttttgtttgtttgtttttgtttttgtttttgtttttttgagatggagtttcactcttgttgcccaggctggagtgcaatggcacaatctcggctcactgcaacctccgccccctgggtttaagcgattctcctgcctcagcttcccgagtagctgggattacaggcatgcgccaacatgtctggctaatttttgtatttttagtagaaatggggtttcgccacgttggccaggctggtcttgaactcctgacctcaggtgatccacccacctcggcctcccaaagtgttgggattacaggcgtgagccaccgcacccggcccttgtgtacatttttataagagaatttttttagctaggagttcagaatttttaaagtaccatttgaatgatcttaatttttctttcatgacaacacattccaaaatgaatcatgcttatgtactaagagggaaaatgtatttaagttaagggtgagagacttaagttataggtgaccttagagacctaaggtgagagacttgacacatggaaggagtaacattagggtctacctctacctcaatttagttagcgatttactacaatttcagagctttaacaaaagataaaaataaatcgtcaccaattgttattgcttctcatctttcatttttcaatgaacaagtaaggtattttcattcttatttttaggattttagtttttagtgtatggtacaaatgaacacagtttatattctaattcttactgcagctcattttaatttttaggatgcaagcacaatttagtattcaaagtgagtagcaacatattcaacttgatcccattgtcttcagttactcttgcccatgaaaaatgttcataaatgaacagggtatttgaccatatgatattagaaaatacagcacattactttatgagaaactacctactgatatgggcttgaaattttggatgaatcattgagcatttctacactagaagtaatttcaaaattgttggtttttataaacaggaaaaaggttgagtagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgtttagaaaaaactataaataaaaaattgatgctaccaaattgtgccttcctaaataacatttttgagagcattttaacagcagtttacaaatatgtaaataatagattaaaaccaaatcttgattctcttgtgaatttttttttcattttaaaaatatgtttttgggctgttttcaaagaaagatgttgatagaacccttagagtgacttgggagaaaacaaagtgtcacatcaaaaagttgagaaacattttgaaagaaaaaattcgaacatgcccatgaaaaaagcatacagcttccacattaacactggctagattaaactctagtcagaaaaactcagcacttaacagacattccatgtcctatatccttaattttgatgttttctgactaaacaatatactcagattgtatacaggcatttcacattattaggacatggaatgttattgtgaagtgccatatactgtgatcaaatctccagtatacggatacgttaaaatgattggagtccaaaggtagggaacactaagaaaatgtataaatagcatacacatttctttgtactcatgagttagaatgcagtgttattcagaaatgtctgtttaaagcacctatgtgattgcatttttctattacatttggattttttagtacatttaattttaagaaaacatgggaaatctagcgactttctatggtaaaccacattttataatgtcacaagttcttgctataggaattaacattctagaattttatattgattataaaagagtatttcagaacatattattctgttaaaatgaactcttgcacagttgccgctacagcaaatgtgtctgccaataatcaaaattcatgagcaaacaatcgtttctggctgtaatgtatgttctttttgaaattctgtatgctaaaatcagttgtttcaaaatttcaagaattccactgagtagtgatttttctgagtactaagctatgatctcatcagaatgtgctggtttcagtctggagatagatttctgaggagcctaatacaagggagagaatgtccaaagaacactactgtggaaagttcttacgatggaaattgacatcttttgtatctcattctccagccgtgaaataaaggcagaggttccctgcaaactagtttggttgggataaatccaatatttatatataatgaaaaataaaagtttgcattattagtttatcacaagacccatgtgacaactcagaaaatattctcagcataatttttttaagagatagggtctcactgttacccaggctggagtgcagtggtgcagtcataacttactacagcctcaaactgcggggctcaaatgatcctcctgcctcagcgtcccaagtagttgagattacaagcccaaccttccataactgaaaactaactttctttttttctttttttattattatactttaagttctagtgtacatgtgcccaacgtgcagatttgttacataggtatacatgtgccatgttggtttgctgcacccgttaactcgtcatttacattaggtatttctcctaatgctatccctcccccagccctgaaaatgaattttttaaacacaaataaaaaatatttcagtg

SEQ ID NO: 376773 - DNA, 2365 bp, Homo sapiens
  misc_feature (2352)..(2352): n is a, c, g, or t
agccggaagtcgcgagatctgaatgagtcaaagccggcggcctcggctcctcagctccacctgacagtaggccgctgatcggccgcgggtcttgtcgaccgctaggccaccaggttcatgtggaggctcccaggcgcccgcgccgcgcttcgggtgatccggacggcggtggagaagctgagccgggctgaagcggggagccagacagcggcgggagcgatggagcgcgctgtagtgcgctgcgtaccttcggaacccaagctgagcctgtcattcgctttggctgatggtagccacaagaacatgcagcgcgaccagagcgagccgctgggtcgagtcctcagccgcatcgctaccaatgccctaaagggtcacgctaaggcggccgccgccaagaagagcaggaagagccggccgaatgctagcggcggtgcggcctgttcagggccggggcctgagccggctgtgttctgcgagcccgtggtgaagctgtactaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtttcagttcttcagtctacaaaggactcttctaaaaggatatgtgttgctaatacccatctttactggcatcctaaaggtgggtatattcgcctcattcaaatggcagtagccttggctcacataagacatgtttcatgtgatctgtatcctggcataccagttatattttgtggggactttaatagtacaccatcaacaggaatgtttcattttgtcatcaatggcagcattcccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaacttgagactctcagaaaaggaagattgaattagcgtgttttttgtttgtttgtttttgtttttgtttttgtttttttgagatggagtttcactcttgttgcagtgagctgagattgcgccactgcactccagcctgagtgaanagaactccgtctc

SEQ ID NO: 376774 - DNA, 492 bp, Homo sapiens
gattacctactgggtcctcttccctgagagagtttatatattctattgccaactcaatatctccatttggacacctaggtacctcaaatgtaacatgccagtctattctcaccccactcccacacatcaaacaccaccaccatctaacctaacacaccagcagtcttctcagtcaatcataattacaatttctttctttctttcagttactcaggctaaaaaacttggacttagtcttgacccctatgtttgtttcatatcccacatctagtccaatatcaaatcctcttatttctactctcacgatatagccaaaatatagccactcttaccctaacaccattcttgtccaaaccattactctcttgcctcaaaatttcctctcttttctgactcccaattcaacttgacaatctatttcacagccattagaatgatcatgccacttctctgctagaaaatccaggaaacatagcaagaccccatctttac

SEQ ID NO: 376775 - DNA, 445 bp, Homo sapiens
acttaataaagcaagatatatcttatatgtggttgactgtgaaacgatgggcattttaaacatttgtgactttaacataaccaaaacagatattggttaatgtctaactgctattctttttaaagcgtatattaatgtatcaagtatatattttactaggacactctgtagtaggtagccatgaaaaaagtgactgttgacttattatcttcttggagttattgctggattaagaggagacattctctgttttttttcttttcttatttttaataacagaaactctggcccatgaaggcctgtgtgctctgagagaatgtgctgagccggccttgtttttctcctgtttcccgtgacagggcgctcctccccacaggacttgccaagtcctcatgcacgttgagtcaacattttggatatgagctcattacatgggaaaaagagt

SEQ ID NO: 376776 - DNA, 936 bp, Homo sapiens
tactgaaattcaattaaatactaataatctcaaatattttaagtgttactctaggcaataggtataaatcctaataagttaaaactattacagctatacttaaaactaagtaaaaatcaataactgggtaaagaggctcaaccaatcataagttaagtctatggcatactgaccttcacccatgcaacctgtggctaaagaagcagcctagctccacacactgaggtggagaaaagcaaactatcttaattatgtgtagtcatgggtatgcatgttggaagttctttgttcagaatgaactttctttcaccccatctttattctctgctccatgaggaaagaaaaacagcttcctcctcattctgatttcaaataaaccttcacaaccacaactgtcataccgttcatcccttattcctccagaatgaaacaccaccaaatcctgaagcgtccaccatggaaatcagttcttggatacctctgggctgtctacatgttaagatggctgcagagtgaccagagaattctggggcgggggatggggagtgctctagtgacagcaggccacacacagacaatggacagtacagctggggcgctggggaagaaagcagtctcccagtactctgctcatccctctccctttcctgttcttgcagattgccctaaagagctccaagcttttgccctctgttctgcagagttccttccttccgttaaaacccatatacagggaccaggatgctcaaacccaaaccccaaacccttatcaaagcacccacaaaaggggggctcacccctagaaccataattccctttagtcttaagaatataagattttccctacctcgttatacttttactaagcctttttttgtttgtttttttgagacggagtcttactctagcctgggtgacagagcaagacctatctcg

SEQ ID NO: 376777 - DNA, 313 bp, Homo sapiens
caagagatgtgcgtaagacaaggtagaaatgtgaagaagaaatcttaatcgatggaccgtaaagtgagaaggaacgagtatcttcacggacttgagagacgcaaaagggctgcacaggtggatgtatcccaaaccccaaacccttatcaaagcacccacaaaaggggggctcacccctagaaccataattccctttagtcttaagaatataagattttccctacctcgttatacttttactaagcctttttttgtttgtttttttgagacggagtcttactctagcctgggtgacagagcaagacctatctcg

SEQ ID NO: 376778 - DNA, 517 bp, Homo sapiens
atttggctgcaggctagacctacagcatggacctatggcataggatttgggctttcccattcaaaggagatgtcacatcccaaatgactcatcttcttcagtacttcaaattcataatcatttcatgtcagtaaaaccaaccaagaattcccctgtgtcagtctcctgtcttctattcctgggagcttttagctctggtgttttttttgtttgtttttttttcctctttaaaacatctctaggctgggattacaggcgtgagctactgcgcctggccttcagtggcattctagaatgttctattgaagttactatgtcagtgcttggatttcttactgtcttccccattagaacgtagtatgtagtgaagaattaaagccaaacataaacatttctagttttgtttttgtttttttccaactttaattatataggctagctggaagagtgagttaatttaacttgttaatttctgaagtgagattgcaacaacccatgaaatgctctgggtttttct

SEQ ID NO: 376779 - DNA, 348 bp, Homo sapiens
ctgggtgtggtggctcatgcctgtaatcccagcactttgggacgccaaagcgggaagatggcttgagtccaggagtttgagaccagcctgggcaacgtagcgagaccctgtctcgacaaaaagtttaaacagttagctgggtggtggctcgcacttgtagtcccagctacttggaaggctgaagcaggaggatcacttgagcccaggagttcgaggctatagtgagctatgatctcaccactacactgcagcctaggtgacagagtgagaccctatttctaaaacataataaaataaaataaaaacaaaatttaaaaactctctttaattcactgccttctctggctc

SEQ ID NO: 376780 - DNA, 453 bp, Homo sapiens
aatcagcttatacataagcaggacagcctgaaaagctactgtgaaatacagaaataggataaatatcctaacacctctttgaaaaaggcagcatgggatgaagatactttacttctaagaatatttattccttggccttttagagggttttcttttttggtggggagggagcagttggagaggaaagtgtgttgtcgtggctggagaagcaaaatgacagagatatggataaggggggagaccttcgaatgccccagaagtcaatgtaactcctataatatagccctacacagggcctttgctaggtgacgactcatcaggaagcttcttaatatctgttactctgtgcccacctactaggaatgatgataggccttctggacaagttaccattgttattaactcaaaagatccagcaatacaatataaaagctcattaatctacaccttgtt

SEQ ID NO: 376781 - DNA, 327 bp, Homo sapiens
ggcagcacagcccaggaacaggcccgacgtggccccctgcactggccttcatcacaggaaagcatcagggacaggcctggagtgactgctcgtacccgccttcatcacagggaagcatctgatatactgtggtgtgccttgaaagtgactggcctctctgattgtcaccaggctgagctgtgaccaggtgagccggtgatcagttaacagagtccccgtagatcccaaaatagccattcgagacccagctggcattctccctcctctccatcccggggctggctgagctcatggatcattttaattggataactggaaaaaaattct

SEQ ID NO: 376782 - DNA, 415 bp, Homo sapiens
agtgttattggctgggcagggtagatcacctgaggtcaggagtttgagaccagcctggccaatgtggtgaaaccccatctctactaaaaatacaaaaattagccaggtgtggtggtgggcacctgtaatcccagctacttgggaggctgaggcaggagaatcacttgaatctgggaggcggaggttgcagtgagccgagatcacgccactgcactccaggctaggcaacaagagcgaaactccatctcaatcatatcagtcaataatattattttaaaaagaagacagataattttctcttcattttacagaacagaaaaaccaagacacaaacaatctcactgtttacctgacatcacccaaatatgtaacagagatagaatcaatgtttactttttctgatttttggtatggt

SEQ ID NO: 376783 - DNA, 560 bp, Homo sapiens
cttcatttcttttcacaccagataggcatcatctttgaaaacatctttactgggtctcttgtctccctcctgcagccactgatctaaatcacagacttttttagaaagagggaaaatagtaaagaaagaaagcgattgagttgatgctcccagccactgtctgtaccctgaattttgtttttctgccatatgtcaggtggcctctcctggaccatcgtcactgtttctcctgcttccctgcagctgcagacacaggagcactgtgtaggtctggccttgagcacccacccacccagtacagagccagcccctgctgttctgaatcagtgcagtgaccacttagaacacagtgcccatgcctctgtgatctgaactgctctttccagttccatacaatgttaagaacccacttaagaatgttttaatcattcagtagtttttcgtggtatataataaaaaagtgatttaaatacaatctattttattttagattatatcattaggggttattttacaaagttacctttaaatactattgtaaataaattaataacaaataa

SEQ ID NO: 376784 - DNA, 4710 bp, Homo sapiens
tttctcgagaacctactgtgtgcatatcccgggcttagtgaagtcctaggcgggctctggcaccaccaggtgcccaagacacagctccttcccgcacctaacagggacttcccatctctctctgtgcccttagcctgctgtgcccacccaccccactgaccccgcgagcgtgctcgggcttgggagggcacgtctgtgggggtgagagacggagccacagcatttggtgactagggggaagccaggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcataagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggagagctgatgatgagcctcctgtggtattacagacctgagcacttacagggaggccgcagtcccagcatgcacgagcccttgcagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttagaaaaggatcgtt

SEQ ID NO: 376785 - DNA, 2827 bp, Homo sapiens
gaaagactcctcctaacaccccataggctctccaccaagctgtgtgctaaaagaggtgactgccatctgtgtgtgccctgggctcaccttttatttcactttcccttgcagggactttccatctaactggaaagatgaagaacatttcccctctcctacgctaggcagggctggggtttgggaggtcagtgacaatcaggggctagagcagatacctggctattctggagaagggggggacctagaagggactcaggaggaatgcctggaggcagtaggtgaggcatacttaggctgaatttccagggaagcttgctggagtcatctcaggtcagcaggcccagcagaggggttaatgtctgccttgctctgggaatgaggtgctttccagccctggtaacaacctccacctgtctccctttgagcccttgcagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttagaaaaggatcgtt

SEQ ID NO: 376786 - DNA, 1287 bp, Homo sapiens
cgagttacagccaacagcacaatataacccacagcactcctttggtttgatttcaggtgggtgtggcttgaagaatcactgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttagaaaaggatcgtt

SEQ ID NO: 376787 - DNA, 2119 bp, Homo sapiens
cccggccggggcctgcgggcgcccagagccgcgccgtccgcgccgcccgttctggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcataagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggctgcagatccctgggccagttggaatttcctctcccggaagctggccacccagcctcacccgcccacccactcctggggtgccctgtacccagtgtgccacctgcagcagagcccgtcccccatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttagaaaaggatcgtt

SEQ ID NO: 376788 - DNA, 416 bp, Homo sapiens
ccttgctccctaggctcttcaggggcttagttcagagataccctaggctaaaaggaaagaggaggaaccagtccttgcacagctgctggtagcttgattccactgccccttcacactctggaaagggagtcccaggaaaatccatactggagacagggtagttgtaggccaggatcactgcacctggggctgggtaggctgcagtgggagagaaagcaggcaggagcaggccagagagggcttctctcattgcccaccttctgtcctgcaggttggaagtactccatgacacacactcggagaaagtcccttcccatgctgagttcgggcctcactggccgccgagagcccctgcagatggaagacagcaacatggagcagggggttgagggtgtggagccaggcatgcccgagag

SEQ ID NO: 376789 - DNA, 4519 bp, Homo sapiens
cccggccggggcctgcgggcgcccagagccgcgccgtccgcgccgcccgttctggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcataagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggagagctgatgatgagcctcctgtggtattacagacctgagcacttacagggaggccgcagtcccagcatgcacgagcccttgcagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttagaaaaggatcgtt

SEQ ID NO: 376790 - DNA, 4520 bp, Homo sapiens
cccggccggggcctgcgggcgcccagagccgcgccgtccgcgccgcccgttctggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcataagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggagagctgatgatgagcctcctgtggtattacagacctgagcacttacagggaggccgcagtcccagcatgcacgagcccttgcagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttcgtcatgatctacaagattgtttcttaaccactaaatacgtttgttttaattgtaccgtcttcgtaactattat

SEQ ID NO: 376791 - DNA, 2779 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagt

SEQ ID NO: 376792 - DNA, 2658 bp, Homo sapiens
tgatttttgctctccccctggccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagt

SEQ ID NO: 376793 - DNA, 2435 bp, Homo sapiens
ccccagagaagagctcagagtgtctctgtccccagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagt

SEQ ID NO: 376794 - DNA, 1834 bp, Homo sapiens
cggtacccatcaggcgaagactgtggcacgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagt

SEQ ID NO: 376795 - DNA, 1416 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagg

SEQ ID NO: 376796 - DNA, 757 bp, Homo sapiens
cggtacccatcaggcgaagactgtggcatccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagt

SEQ ID NO: 376797 - DNA, 2745 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctggcgcaatcacgccaaaaaaaatttaaaaatataaatgaaaatacagggggcataatatt

SEQ ID NO: 376798 - DNA, 2389 bp, Homo sapiens
  misc_feature (23)..(23): n is a, c, g, or t
cccgccgtaccaagttgcgcccnccgtaccagttgcggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagt

SEQ ID NO: 376799 - DNA, 2469 bp, Homo sapiens
cagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtacgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactccctttggccaggcacagtggctcacgcctgtaatcccagcac

SEQ ID NO: 376800 - DNA, 284 bp, Homo sapiens
acgcggcaacgaggtcatctccgtgatgaatcgggccaagaaagcaggtgagctggggcccgctgctgggtcacggccaggtcacagacgttggtcacatatactgacctctgacacccttagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaac

SEQ ID NO: 376801 - DNA, 757 bp, Homo sapiens
gaagggattttcttcaggaacctccttgtggctctgccatggcggggagggttggggagtgggccctacatccaatgactggtgttctcataaggagagagagacaaagagtagacagacacaagggagaaggccgtgtgaagatggagacagagattggaatgatacagccacaagccaagaaacatctgcggccgtcagaagttggaagaggcaaggaatgatttattctttcccactcattgtttcaccaatgagcaccttccatgtgccaccgttctgaccctgctgacaatgtggtttcagacttctggcccccagaactgtgaaagagtaaatttctgttaagttatcttgcttgtggtactttgttacagcagccctgtggatctaatatagtcataagagacattgtgacctcctccctgctctcttgaaccactcattctgggagaagtcagctgccatgtcatgaagctactcagggaggtccatggagaggtccacatggcaaggaactgaggcctcctgccagtagccagcaccatcttgctggccatgtgagcgtgccatcttagatgcagatcatacggccccagtcaagccttcaaatgactgcatccctacttgacattttgactgtaacctcatgagaaaccctaagccagaacaccagctaagccactccccaattcctcatcaagagaaactgagataataaatgtttattattgttttaagctactaaattttgagg

SEQ ID NO: 376802 - DNA, 743 bp, Homo sapiens
ctgaaagctcagctgaccccgaggctcttctggtcatgcttagagtgggccctacatccaatgactggtgttctcataaggagagagagacaaagagtagacagacacaagggagaaggccgtgtgaagatggagacagagattggaatgatacagccacaagccaagaaacatctgcggccgtcagaagttggaagaggcaaggaatgatttattctttcccactcattgtttcaccaatgagcaccttccatgtgccaccgttctgaccctgctgacaatgtggtttcagacttctggcccccagaactgtgaaagagtaaatttctgttaagttatcttgcttgtggtactttgttacagcagccctgtggatctaatatagtcataagagacattgtgacctcctccctgctctcttgaaccactcattctgggagaagtcagctgccatgtcatgaagctactcagggaggtccatggagaggtccacatggcaaggaactgaggcctcctgccagtagccagcaccatcttgctggccatgtgagcgtgccatcttagatgcagatcatacggccccagtcaagccttcaaatgactgcatccctacttgacattttgactgtaacctcatgagaaaccctaagccagaacaccagctaagccactccccaattcctcatcaagagaaactgagataataaatgtttattattgttttaagctactaaattttgagg

SEQ ID NO: 376803 - DNA, 975 bp, Homo sapiens
agttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgcttttcttgtaaccaagcttagctagatccggaaagggttaaactaggaattttccaggacgtcagtgtgagctgcgtgagggagaggcgccttttaaaagggcggggcttgggggtgggaattcaacgggaagggatacggggggaaggtgaaggggcaacggtgtcgttttcgtttgttttcc

SEQ ID NO: 376804 - DNA, 814 bp, Homo sapiens
cactggcgggcgcaggttgcctaggggctgggctgggccgggccaggcgcgatggcagggttctctccttggcggcggcggcagcggcggaggcggcggcggcggcgggcgaggcagcccttcgcgggcagcaccagaactggtcggtgatttaggtagtttcctgttgttgggatccacctttctctcgacagcacgacactgccttcattacttcagttgaaatcgtctccaggtacctctgcgcgcgggggtcgggccgggcggggcatcacggccctggtcgtgccaggcctgcggtggcaacctcggctttccctgctcaggagcctcgtgtctttctccgcagcgctttgccagccggccggctttccccttccaccacacacctccacctggtcccttctctctgtaagctcggccgctgctaggagtcgcctctcttttcttccttcttttccctgtcttcccttcctcttttatctcttctttctttttttcttctttcctttgctccttcctgctttcttttcttccgttggtctttttttcatcttccgtctctgccagattctatctcacctccttatctccttcccaaagcatccttggggaggggcccagagctggcttcaggagagcctagggggtctcactttcctctgcggctcaagtagaggttgggaagtctgccgaggaagggcccgcgtggggcggctgccgagggcggtgggtttgggcctggtgtgttactctgcagacaaggcctcggttatgatcacgaccggatggcggcagccttgcgtttcttcgc

SEQ ID NO: 376805 - DNA, 479 bp, Homo sapiens
cttccttggccaagagaagggcttacaggcatggacatgcaggttggcaaacgggcttgactttggccttctctctgtaagctcggccgctgctaggagtcgcctctcttttcttccttcttttccctgtcttcccttcctcttttatctcttctttctttttttcttctttcctttgctccttcctgctttcttttcttccgttggtctttttttcatcttccgtctctgccagattctatctcacctccttatctccttcccaaagcatccttggggaggggcccagagctggcttcaggagagcctagggggtctcactttcctctgcggctcaagtagaggttgggaagtctgccgaggaagggcccgcgtggggcggctgccgagggcggtgggtttgggcctggtgtgttactctgcagacaaggcctcggttatgatcacgaccggatggcggcagccttgcgtttcttcgc

SEQ ID NO: 376806 - DNA, 2074 bp, Homo sapiens
  misc_feature (1223)..(1223): n is a, c, g, or t
  misc_feature (1227)..(1227): n is a, c, g, or t
  misc_feature (1230)..(1230): n is a, c, g, or t
  misc_feature (1260)..(1260): n is a, c, g, or t
  misc_feature (1267)..(1267): n is a, c, g, or t
  misc_feature (1276)..(1276): n is a, c, g, or t
  misc_feature (1294)..(1295): n is a, c, g, or t
  misc_feature (1299)..(1299): n is a, c, g, or t
  misc_feature (1309)..(1309): n is a, c, g, or t
  misc_feature (1311)..(1311): n is a, c, g, or t
  misc_feature (1321)..(1322): n is a, c, g, or t
  misc_feature (1324)..(1326): n is a, c, g, or t
  misc_feature (1329)..(1329): n is a, c, g, or t
  misc_feature (1338)..(1340): n is a, c, g, or t
  misc_feature (1342)..(1342): n is a, c, g, or t
  misc_feature (1347)..(1348): n is a, c, g, or t
  misc_feature (1350)..(1350): n is a, c, g, or t
  misc_feature (1353)..(1353): n is a, c, g, or t
  misc_feature (1360)..(1360): n is a, c, g, or t
  misc_feature (1366)..(1366): n is a, c, g, or t
  misc_feature (1368)..(1369): n is a, c, g, or t
  misc_feature (1373)..(1373): n is a, c, g, or t
  misc_feature (1388)..(1388): n is a, c, g, or t
  misc_feature (1390)..(1390): n is a, c, g, or t
  misc_feature (1396)..(1396): n is a, c, g, or t
  misc_feature (1398)..(1398): n is a, c, g, or t
  misc_feature (1410)..(1410): n is a, c, g, or t
  misc_feature (1416)..(1416): n is a, c, g, or t
  misc_feature (1419)..(1419): n is a, c, g, or t
  misc_feature (1421)..(1421): n is a, c, g, or t
  misc_feature (1428)..(1429): n is a, c, g, or t
  misc_feature (1431)..(1431): n is a, c, g, or t
  misc_feature (1433)..(1433): n is a, c, g, or t
  misc_feature (1441)..(1442): n is a, c, g, or t
  misc_feature (1444)..(1444): n is a, c, g, or t
  misc_feature (1447)..(1448): n is a, c, g, or t
  misc_feature (1452)..(1452): n is a, c, g, or t
  misc_feature (1464)..(1464): n is a, c, g, or t
  misc_feature (1468)..(1472): n is a, c, g, or t
  misc_feature (1474)..(1474): n is a, c, g, or t
  misc_feature (1477)..(1478): n is a, c, g, or t
  misc_feature (1481)..(1481): n is a, c, g, or t
  misc_feature (1483)..(1483): n is a, c, g, or t
  misc_feature (1486)..(1486): n is a, c, g, or t
  misc_feature (1488)..(1488): n is a, c, g, or t
  misc_feature (1493)..(1493): n is a, c, g, or t
  misc_feature (1501)..(1502): n is a, c, g, or t
  misc_feature (1504)..(1504): n is a, c, g, or t
  misc_feature (1506)..(1506): n is a, c, g, or t
  misc_feature (1511)..(1511): n is a, c, g, or t
  misc_feature (1520)..(1520): n is a, c, g, or t
  misc_feature (1522)..(1522): n is a, c, g, or t
  misc_feature (1525)..(1525): n is a, c, g, or t
  misc_feature (1531)..(1531): n is a, c, g, or t
  misc_feature (1534)..(1534): n is a, c, g, or t
agttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaaccnccgnccngacccccccccccccaatgccccaccgccnccggccncgccgcccngccccccccccccgcgcnnccancccccacccncnccccgccgcnncnnnccnccccccccnnncncccgnncnccncgccccnccgcgncnncccnccgtcccgcgacccncncccccncncaccgggcgacncccccnccncnatcccgnnananagaacccnncncgnncccnggccgcccacgngggnnnnnanacnnccncnccngngcacngccccgcnncngnacacnccccccgtncnacnaggccnccnccctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaatcggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctattttttgcgg

SEQ ID NO: 376807 - DNA, 1894 bp, Homo sapiens
agttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaatcggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctattttttgcgg

SEQ ID NO: 376808 - DNA, 1459 bp, Homo sapiens
atgtgcgtcttctgctcctaaacccagtgtttctcttccccgcagataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaatcggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctattttttgcgg

SEQ ID NO: 376809 - DNA, 2067 bp, Homo sapiens
agttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaatcggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctattttttgcgg

SEQ ID NO: 376810 - DNA, 796 bp, Homo sapiens
  misc_feature (296)..(296): n is a, c, g, or t
  misc_feature (299)..(300): n is a, c, g, or t
  misc_feature (303)..(303): n is a, c, g, or t
  misc_feature (305)..(305): n is a, c, g, or t
  misc_feature (309)..(310): n is a, c, g, or t
  misc_feature (313)..(313): n is a, c, g, or t
  misc_feature (321)..(321): n is a, c, g, or t
  misc_feature (323)..(324): n is a, c, g, or t
  misc_feature (327)..(327): n is a, c, g, or t
  misc_feature (331)..(331): n is a, c, g, or t
  misc_feature (336)..(338): n is a, c, g, or t
  misc_feature (341)..(341): n is a, c, g, or t
  misc_feature (343)..(344): n is a, c, g, or t
  misc_feature (358)..(358): n is a, c, g, or t
  misc_feature (360)..(360): n is a, c, g, or t
  misc_feature (362)..(363): n is a, c, g, or t
  misc_feature (374)..(374): n is a, c, g, or t
  misc_feature (382)..(382): n is a, c, g, or t
  misc_feature (414)..(415): n is a, c, g, or t
  misc_feature (422)..(422): n is a, c, g, or t
  misc_feature (427)..(427): n is a, c, g, or t
  misc_feature (457)..(457): n is a, c, g, or t
  misc_feature (460)..(461): n is a, c, g, or t
  misc_feature (463)..(464): n is a, c, g, or t
  misc_feature (474)..(474): n is a, c, g, or t
  misc_feature (485)..(485): n is a, c, g, or t
  misc_feature (495)..(495): n is a, c, g, or t
  misc_feature (507)..(507): n is a, c, g, or t
  misc_feature (578)..(578): n is a, c, g, or t
  misc_feature (584)..(584): n is a, c, g, or t
  misc_feature (612)..(613): n is a, c, g, or t
  misc_feature (640)..(640): n is a, c, g, or t
  misc_feature (645)..(645): n is a, c, g, or t
  misc_feature (655)..(655): n is a, c, g, or t
  misc_feature (669)..(669): n is a, c, g, or t
  misc_feature (686)..(686): n is a, c, g, or t
  misc_feature (720)..(720): n is a, c, g, or t
  misc_feature (728)..(728): n is a, c, g, or t
  misc_feature (735)..(735): n is a, c, g, or t
  misc_feature (754)..(754): n is a, c, g, or t
agttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcggggnggnnggngntgtnngcnggtggggngnnccnggcncgcgnnnggncnngggggcgcgtgggngngnngccgcgagggngcgcgcgnggcgggcgggggggcggcgcgggggggggggnngggtggngggtngtgggtggggggggggtcgggggggggggncgnngnngggggggggntggcgcgtggngggggggcgntggggggggttngagagggtgggggggggggctcgggccaggaaggggggtgacctggtccgcagcggctgtgaacagctcancaactnttggtcccgtgacctgagactagtggcnntggtgggtgtctcccttccaggtgtgnagtangaggagaaanagcaaaccccaagncgaaaggggcgtcgctntgcttctggaaaagaacagagtggcgtggagganagtgtagnaaggcgnggcgggagtaacaaaggcncgcccccagtcggagtcgccagagtatagccccaaggcaggc

SEQ ID NO: 376811 - DNA, 1815 bp, Homo sapiens
cactggcgggcgcaggttgcctaggggctgggctgggccgggccaggcgcgatggcagggttctctccttggcggcggcggcagcggcggaggcggcggcggcggcgggcgaggcagcccttcgcgggcagcaccagaactggtcggtgatttaggtagtttcctgttgttgggatccacctttctctcgacagcacgacactgccttcattacttcagttgaaatcgtctccaggtacctctgcgcgcgggggtcgggccgggcggggcatcacggccctggtcgtgccaggcctgcggtggcaacctcggctttccctgctcaggagcctcgtgtctttctccgcagcgctttgccagccggccggctttccccttccaccacacacctccacctggtcataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaatcggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctattttttgcgg

SEQ ID NO: 376812 - DNA, 1574 bp, Homo sapiens
ttaggcatctatttaaatattacctagacggtcgtaatttgtctgggccctatagccctggtgccgtaagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaatcggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctattttttgcgg

SEQ ID NO: 376813 - DNA, 781 bp, Homo sapiens
agttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccagtaagtgtctcctcccttcaaatccgccgccgcctccacgccggcctcccggatctgctggcccgccaggtttctctcgagcctgccttcgtcctcgctggaagcctctcgagttggggccaggagcc

SEQ ID NO: 376814 - DNA, 241 bp, Homo sapiens
gcctttacaaattcagtgttttttggcaactttatggatcataactactgcaaatgataagaataactccagttattttattttttcaaaaattgagtttcctctttaatgcatttttcctaaatgatatattttaagttatttttcctgatcactagatcttcttcaatgtaattgtcatatctgtgtagcaatacagcatacagatgtgctattagtatatttactaaaagctctttta

SEQ ID NO: 376815 - DNA, 940 bp, Homo sapiens
cctgggcgtgtgctaaggccagagctaccagatgggtccagctgccgcaggctctccaggcactgtcccctaagtgacagctgttactgcctgggagagctcaagtgcaaagactatcctgttctcccataaagaggaggaaaaggaagatacagaaatcggtgctgctcccaacagcagatcaaggcagtcgtcaggaactcaggatccggggggtcttcacggcttctctgcccaggggccagaaccgaggaggccaggagggctgctggggctaaggggtctaaggacctcgttgcacacgctaccaggagcaggggcatggagcacagtgagggggctcccggagacccagccggtactgtggtaccccaggagctgctggaagagatgctttggttttttcgtgtggaagatgcatctccctggaatcattccatccttgccctggcagctgtggtggtcattataagcatggtcctcctgggaagaagcatccaggcaagcagaaaagaaaagatgcagccaccagaaaaagaaactccagaagtcctgcatttggatgaggccaaggatcacaacagcctaaacaacctaagagaaactttgctctcagaaaagccaaacttggcccaggtggaacttgagttaaaagagagagatgtgctgtcagttttccttccggatgtaccagaaactgagagctagtgagggttcagagaagccccatcctaagccagacacatgatgtgggctcagctcagtggcctgaaacctctcaggttttagagtctctcccaagaagccgcttttttctttttctttctttctttttttttttcttagcagatacaatgaatgaactgcaagcaaactaaaattctgttattaaaaaaaatcttttattaaaatgctcctggaagggagcaggtggtattgc

SEQ ID NO: 376816 - DNA, 885 bp, Homo sapiens
cctgggcgtgtgctaaggccagagctaccagatgggtccagctgccgcaggctctccaggcactgtcccctaagtgacagctgttactgcctgggagagctcaagtgcaaagactatcctgttctcccataaagaggaggaaaaggaagatacagaaatcggtgctgctcccaacagcagatcaaggcagtcgtcaggaactcaggatccggggggtcttcacggcttctctgcccaggggccagaaccgaggaggccaggagggctgctggggctaaggggtctaaggacctcgttgcacacgctaccaggagcaggggcatggagcacagtgagggggctcccggagacccagccggtactgtggtaccccaggagctgctggaagagatgctttggttttttcgtgtggaagatgcatctccctggaatcattccatccttgccctggcagctgtggtggtcattataagcatggtcctcctgggaagaagcatccaggcaagcagaaaagaaaagatgcagccaccagaaaaagaaactccagaagtcctgcatttggatgaggccaaggatcacaacagcctaaacaacctaagagaaactttgctctcagaaaagccaaacttggcccaggtggaacttgaagctagtgagggttcagagaagccccatcctaagccagacacatgatgtgggctcagctcagtggcctgaaacctctcaggttttagagtctctcccaagaagccgcttttttctttttctttctttctttttttttttcttagcagatacaatgaatgaactgcaagcaaactaaaattctgttattaaaaaaaatcttttattaaaatgctcctggaagggagcaggtggtattgc

SEQ ID NO: 376817 - DNA, 3263 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaagccaaaaaccaaatttgtatttaaggtatataaattttcccaaaactgataccctttgaaaaagtataaataaaatgagcaaaagttgatcagagtgggaaagtagttcttttcaatctagaaaaggccaaagtaatgattgagatacactgtctccacttgctttgattttgttgtttcattttataaaaggtagaaaaaattttggaaatgtcattgtcagttatttggcctgcagcactgtcttggggtgaatggatgtagccttcatgtaaaaacactgtgtggagcagctttatctgcattcaaacctcaaggtagggatgagggactccccagacatttctctggtgcttttctgtccagggtaagccacgaggcattgtcatctcagggtagtgcaccgcacatgctcacacctaggcttacccaggcagaagcggcacagattccagtctggctattgcttatcacatccctggagtgtgaaacatttcccaaggggctgggctggggacatgagcctcccatgagctgtacttttgcaaatgtattttacaagtgtatgcacttaccca

SEQ ID NO: 376818 - DNA, 889 bp, Homo sapiens
gcagcatcttacaaatgctacctgtctccatggcttgctagatccacggggtaggaaactgctcactcagcatcctccccatggaagctcaagcatgggaacagcttcgggcctggtgcagctaaggaacattggccgtggtttcaccaaaggaggtgccatctaggtaatgggagggcagtggcaggagccactggcttagactggaagtgaaaatgaaagcacctggaggctgctggagtaaggtgccatcaggcatgtaaagtttagaagcagcagagtgtgctcatagaaaaagaaaaaaaaaggaatttgctgtatgtgataacaactaacattcatgtacttgagctcatttcactaaacacagcttcagagaagtccatttgtgtgcatgtgtgtgtgtgcttaatatcagaactcctcactaacatgccactttatctcgaggtatgacaggataaaatgtatgtgtaactcctagaaaatcctgttctatccgttttttgaagccccttttacccactttccaaatgaatcctgaattaccaacccaagacaaagaattataggtcacaatttaaaatgaaatggcctttttcttattattaaactacagagcccaccaagaattacacaatagaaaaatcacaagaaatctggaatgatccagtggtcccccaaggaggacaaatctcttgatgcagactcttaatgacaggcttggaaacaaatgtttgttagttgtagcagttcccatactttcagaataactttggtagcttagagcatttctgaatttatctttaccctagaagctaaaaaaaaaaacttcttaaagagctgcagttgcacatcccttcgttttttagactgataaacttgacta

SEQ ID NO: 376819 - DNA, 1028 bp, Homo sapiens
tcttctcgttgtttctgcattcccactagaattttaggtgactcaggcagggaggttatagctccttaaagttttaggaggctaagctgtctagaaacacagtagaactttaatccccccgaaaagttgatgttgtattctgatggaatttcggttgatggaaagcgtacacaatgtgtttatttctagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaagccaaaaaccaaatttgtatttaaggtatataaattttcccaaaactgataccctttgaaaaagtataaataaaatgagcaaaagttgatcagagtgggaaagtagttcttttcaatctagaaaaggccaaagtaatgattgagatacactgtctccacttgctttgattttgttgtttcattttataaaaggtagaaaaaattttggaaatgtcattgtcagttatttggcctgcagcactgtcttggggtgaatggatgtagccttcatgtaaaaacactgtgtggagcagctttatctgcattcaaacctcaaggtagggatgagggactccccagacatttctctggtgcttttctgtccagggtaagccacgaggcattgtcatctcagggtagtgcaccgcacatgctcacacctaggcttacccaggcagaagcggcacagattccagtctggctattgcttatcacatccctggagtgtgaaacatttcccaaggggctgggctggggacatgagcctcccatgagctgtacttttgcaaatgtattttacaagtgtatgcacttaccca

SEQ ID NO: 376820 - DNA, 4184 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataagtaagatatctttaacattatataacatacatgtactattgaatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376821 - DNA, 3490 bp, Homo sapiens
  misc_feature (21)..(21): n is a, c, g, or t
gttttatttaagggttatgtnagtcataagagaaggtagtttctaactatattaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376822 - DNA, 4700 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaaaaaaaaaaaaaacacaaaagaacacaacaccccaagaaacacgaaaaaaaattttgtgggggcccccccccccggagagtttttcaacccccctttgggggcgccgggccccaagtgagagaaaggtgcacggttcccaggagagcctgcggatcagacagaggggcggtgtcttccacccacaaaaaaacagcccggggcggccaaccgggggtttttggaacacccccggataggagggctcggggcgccaatcggcggctaacacaaagggggcacaggagagcaagaaaataatccccacgccccgtcgaggtgaaaacaacatcgacaaaaacgacagccagacatcacgaagccaggcagccacgccgcgacatcgtactaagaacagcaatgacaggaagccaacggaaggtcaggaagcaccacaacagcagcaatgcaacactaggatcaagagaacacaacagaaccacaacaaagtagcgtaccagcagctagcaagacaagcatgagacgtgcaac

SEQ ID NO: 376823 - DNA, 3487 bp, Homo sapiens
atacacacatatcacccaacccaaatataaacaacaacgaaaaaaagattcggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376824 - DNA, 4290 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaaaattgctgaggtttagctgtcagttctttttgccctttgggaattcggcatggtttcattttactgcactagccaagagactttacttttaagaagtattaaaattctaaaattctat

SEQ ID NO: 376825 - DNA, 4481 bp, Homo sapiens
  misc_feature (4481)..(4481): n is a, c, g, or t
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaacaacaaacaaccacaaccctcccacacccccccccccccaccccccaaaacttttggggcgccacacgccccataaacaccttctaaaaccctgatgggccacagcggggccacaagtgtgacagcgaaccagtgggcaccaacgactgccccaggaagacacctgtggacaacacacgcagggagaggcacccacacagataaaacaaccgccggggagaaacacgaggttctcaccaacaaccaaagggagctcgcgacacaaagagagacaacacagagggccaagcaggcccaaataaaacgcgn

SEQ ID NO: 376826 - DNA, 4118 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376827 - DNA, 3795 bp, Homo sapiens
  misc_feature (3709)..(3709): n is a, c, g, or t
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttcccttgganggtcctctccccgtgtttccgacctttggggtggtgtgcgaggtgtcttctctttgccgtagggggggcccagggggggggggtcc

SEQ ID NO: 376828 - DNA, 3819 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttcccattggaagggcactctcccggcttccgccttttgggggcggtcgggcatcggtttcctctctctttccaaattaaagtgggggcccccagggtgggtgttcgcccaatacgctggg

SEQ ID NO: 376829 - DNA, 1083 bp, Homo sapiens
ttgcatatggcaaggccaaggtcagaagatgaaccacgtgacgaaatagaaaaagctacctatggagttgtttgcatatggcaaggccaagtttagggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376830 - DNA, 3671 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaagatccacggggtaggaaactgctcactcagcatcctccccatggaagctcaagcatgggaacagcttcgggcctggtgcagctaaggaacattggccgtggtttcaccaaaggaggtgccatctaggtaatgggagggcagtggcaggagccactggcttagactggaagtgaaaatgaaagcacctggaggctgctggagtaaggtgccatcaggcatgtaaagtttagaagcagcagagtgtgctcatagaaaaagaaaaaaaaaggaatttgctgtatgtgataacaactaacattcatgtacttgagctcatttcactaaacacagcttcagagaagtccatttgtgtgcatgtgtgtgtgtgcttaatatcagaactcctcactaacatgccactttatctcgaggtatgacaggataaaatgtatgtgtaactcctagaaaatcctgttctatccgttttttgaagccccttttacccactttccaaatgaatcctgaattaccaacccaagacaaagaattataggtcacaatttaaaatgaaatggcctttttcttattattaaactacagagcccaccaagaattacacaatagaaaaatcacaagaaatctggaatgatccagtggtcccccaaggaggacaaatctcttgatgcagactcttaatgacaggcttggaaacaaatgtttgttagttgtagcagttcccatactttcagaataactttggtagcttagagcatttctgaatttatctttaccctagaagctaaaaaaaaaaacttcttaaagagctgcagttgcacatcccttcgttttttagactgataaacttgacta

SEQ ID NO: 376831 - DNA, 841 bp, Homo sapiens
ggaaaggagtagaaaaagcagtaactgacaacttgaataatacaccagagataatagactaaataccaccctaataacaaaaaggacaaattaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376832 - DNA, 818 bp, Homo sapiens
ttcatccgccaactaatatttcactttacatccaaacatcactttggcttcgaagccgccgcctgatactggcattttgtagatgtggtttgactatttctgtatgtctccatctatggttaatttcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376833 - DNA, 501 bp, Homo sapiens
ttttttttctcacattccagccattttcttggtttgtaagttagcatgaaaatggaaatcatgattgaactaaaagcccatccgtccatctcttcgatatccaggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcggtgagtgggagtttgagcacatagtcccaccattccatgtgtgtgaagtccctcttcatcgccgccagtcagctcatacagatagtgcgtttgggacatgaaattgcagatcttatacttaccccaaatgagcccccgataggatttaataaaccaccacaaatgtttgtggttgtggttcactctctggaacatattgtggaaatgatggttttggatgtgagtcaatgtaatctgcaacccgttcttgg

SEQ ID NO: 376834 - DNA, 358 bp, Homo sapiens
cccgtttcacatgagcagatttgacacgttgctctgtccccagacttgcataacagcaaaaagctttatgcagtctggatggattcacaaaattaagccagtgggcagcagagtaataatccgtcagcttaggtgatataaaaggtcttgattagcccaggataatacatagtacatgctgaaggccctcttattccacggtatttatttgccattgcaagtatcttcctactacttcattctagaatagacaagcaatgtttaatgtatgagtctgcatttcacaagatcagtgtaataaacttaaccacattttgtctttttacagatgaacacagtatagagcatgaattttttt

SEQ ID NO: 376835 - DNA, 305 bp, Homo sapiens
cagcgtggtaccatgcaactgtatgaattaatggaaactcccagaaatactgtttattttagacatgaattgagcctagtttttttgtaaccttgttaacagtttgccagcattttccagggccttgggaaaaatttcatattgacacataagcaggaagcctgtagtacatgtcagaagatctggaaggcaagtggggacttgactttggagtgtaaccagcaagtacacaccctgaagaaaacgatggctataatcatgcccttcccattacaggctcagtcggggaatattcagagcacagt

SEQ ID NO: 376836 - DNA, 750 bp, Homo sapiens
ctcggctgcaccggggggatcgcgcctggcagaccccagaccgagcagaggcgacccagcgcgctcgggagaggctgcaccgccgcgcccccgcctagcccttccggatcctgcgcgcagagtgagtggccgtgaggttccgggtgccgggggtgggacgcgcagggacagagtcctcgggccgtgcagttggacgccgggcgaggacgggccgtctgtgctgacccgcgaatagtgatcccagaggaagaacgcgtcctgagtattccaagtgcgagcagtgccacctgttctcggagatggcactgctcagcacgattgtccttgccagtcgtgctctggcagtgaagaggacttgtgaaatataattttcctctagaaggcactgcaccttcccatttaccgtcactttctcccgtttccacccctttccatcagtcacgttttcttcttttcgcagaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggtcagtaaatgttcatggaatcagatgaatgagtacatgacttcggaatcttaattatgtttctatgttcaaagatggaagggcttaatgtcttcctagagtttaaaagtgatgtttagtttttgcagacccccca

SEQ ID NO: 376837 - DNA, 308 bp, Homo sapiens
ctctgaatctataacccttgccgtaacttcagacacttatctttcagagcacactgagatactaagaatcattaaatctgggagagattgaatattgagtcttcagacttgccactgattgggcccaggatctctgtggcctgttgcaatgttaattgggcttttgaaagttttaggatctgtgaataattatattcttttcttctttccttttctcttccaagggtcctctcatcgttactgaagagcttcactcccttagttttgaaacccaattgtgccagcctggtttggtaattgacctcgag

SEQ ID NO: 376838 - DNA, 387 bp, Homo sapiens
ttgcctcaaccttaatggaaatgctaacttatctatcctttgctgggtatttgcagctcgtttgtggtggaaagacagccctgcatgccaacgcaccctcagaggccgctggtcttgaagacaggggtccagttcactgtgaagttgaggtaacaagggaaagatggcatcccatacatcacctgtcacgtagtttgtacccctagtttccttttataaaaactgttatatagggtgcttttgaggaaataatttttcagggggcactttaatatgaactcttactgagaatatctgagagtcttttattaatatattcatagtagaaatgtaactgatatacatatatgtacacactcctggtttttttccaatcataaatgtaat

SEQ ID NO: 376839 - DNA, 493 bp, Homo sapiens
agcgtgttaagagactcgaattctttgctgctgtgtgctgctgtgtgtgcacgggtgtgtcttcaaatgaccccaaagatgccatgtatttagattttggagttacaagtaaattttagtgagtaaacaagttcacaaatgtgcatctgtaaataatgaaaattgactgtatttctcttcccctactgtgaaagcacctgtgtgtcatataaactagaattgaactttgggatggacatatgttttagtgccacacttgtgactggtgtctctgtagtaacccttagattttgggtgttttctctctagaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtatatgcatattaacttgttatgtttataaaaattgaaattcataaa

SEQ ID NO: 376840 - DNA, 443 bp, Homo sapiens
ttgctgtgctgaatgggacagttccatccttggcacctggggagtctttgcaaatgatggtgggaggggccatggtaagtcattgttttagatttttgttcataatgtctgcatttgtatactttcaggaaaatataaatgataaaaattttcccttctggctttggattgaaagcatcctagaactcattaaaaaacacctgctccctctctggaatgatgggtaagggccaccgatagatgtattttgaaacatatttttagtgctgcgaggttgagacaaggcctgagtccagcttcagtatttgactaggcgtgtgtgaatctcacaggagtgcgcatttataggctgccccttcagggcttcagaagagtagaacctcataacattaaccttacactttcttagtacaagtatatgtattggcaaagctaaattaaaa

SEQ ID NO: 376841 - DNA, 4003 bp, Homo sapiens
attaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376842 - DNA, 4172 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376843 - DNA, 3670 bp, Homo sapiens
  misc_feature (43)..(43): n is a, c, g, or t
  misc_feature (93)..(93): n is a, c, g, or t
  misc_feature (120)..(120): n is a, c, g, or t
  misc_feature (129)..(129): n is a, c, g, or t
  misc_feature (132)..(132): n is a, c, g, or t
  misc_feature (140)..(140): n is a, c, g, or t
  misc_feature (143)..(143): n is a, c, g, or t
  misc_feature (156)..(156): n is a, c, g, or t
  misc_feature (160)..(160): n is a, c, g, or t
  misc_feature (164)..(164): n is a, c, g, or t
  misc_feature (168)..(169): n is a, c, g, or t
  misc_feature (171)..(171): n is a, c, g, or t
  misc_feature (176)..(177): n is a, c, g, or t
  misc_feature (179)..(180): n is a, c, g, or t
  misc_feature (187)..(187): n is a, c, g, or t
  misc_feature (195)..(195): n is a, c, g, or t
  misc_feature (204)..(205): n is a, c, g, or t
  misc_feature (208)..(209): n is a, c, g, or t
  misc_feature (214)..(214): n is a, c, g, or t
  misc_feature (224)..(226): n is a, c, g, or t
  misc_feature (242)..(242): n is a, c, g, or t
  misc_feature (247)..(247): n is a, c, g, or t
  misc_feature (250)..(250): n is a, c, g, or t
  misc_feature (253)..(253): n is a, c, g, or t
  misc_feature (262)..(263): n is a, c, g, or t
  misc_feature (265)..(265): n is a, c, g, or t
  misc_feature (267)..(267): n is a, c, g, or t
caaacagcggctggtccggccggattccgggtcgtttctgccncctgtcacagctggatgtccatatagtcgcctctccttggagaataaccnctctgcccccgcccccccccggcccancccgccccnccnccggctcnccnccggccccccccncccnctgncccnnanccccnncnnccgcccnacggcagncaggccaannccnnccccngccccccccnnncctccggccccgcccnggccnatnccnccgccccgnncngnccgccccacacgccagcgccctccccgcccagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376844 - DNA, 3244 bp, Homo sapiens
  misc_feature (2)..(2): n is a, c, g, or t
gncgactctagagcgaccccctcctaccccacgcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376845 - DNA, 2481 bp, Homo sapiens
aaggtctttgtcatcctttagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376846 - DNA, 4121 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376847 - DNA, 3360 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggtggagcacccatatgggtgctccatcccccatgggtgctccatcccccacactgccttgcacttagctttcaataaatgtttgcagaactgaaaagcattaaaaatacagcccggaaaatgttcatgccatttttttccttcctattggactgtagcacgttgccagaatgctcc

SEQ ID NO: 376848 - DNA, 3040 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggagggcagttttcacttttcacgttggttataggccccgtctttttgtgtgaaaaaacgtattaggagagtgtaaagagaatggggaaaaatatttgttcggggaagagacgtgagcaattt

SEQ ID NO: 376849 - DNA, 2489 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcggtgagtgggagtttgagcacatagtcccaccattccatgtgtgtgaagtccctcttcatcgccgccagtcagctcatacagatagtgcgtttgggacatgaaattgcagatcttatacttaccccaaatgagcccccgataggatttaataaaccaccacaaatgtttgtggttgtggttcactctctggaacatattgtggaaatgatggttttggatgtgagtcaatgtaatctgcaacccgttcttgg

SEQ ID NO: 376850 - DNA, 1359 bp, Homo sapiens
attggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagattgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaa

SEQ ID NO: 376851 - DNA, 785 bp, Homo sapiens
ccctgttgaaggaccagcagccggggaccttcctgctgcggttcagtgagagctcccgggaaggggccatcacattcacatgggtggagcggtcccagaacggaggcggtgagtgggagtttgagcacatagtcccaccattccatgtgtgtgaagtccctcttcatcgccgccagtcagctcatacagatagtgcgtttgggacatgaaattgcagatcttatacttaccccaaatgagcccccgataggatttaataaaccaccacaaatgtttgtggttgtggttcactctctggaacatattgtggaaatgatggttttgaaaagacaatgccaattctttcctttgcatcaggtttgttatctgcagatcaaggatgtgagtcaatgtaatctgcaacccgttcttggaaggaatcacatttcccacaggagtaagcatccacattctcttagggtcatcccagagtagagtgtgcagatgagacaggcttcgggagaagacttcatacacatcatcagccagggagttgatgcaggacctgttgggacgagtggcagcctctaccctgccttcaaacagagcagctgcaaatttatctttatcatatatggggtttctatttaatcaaatgagtccatggctaaaagactccagaaaccttggtgttatgaagcaggtttctgagggtgaagctcaacagcgtaaatgaaaaaatcataaagaccaactgattacttttcactgttgtttagagtttggtctgtttgaagggcaggagg

SEQ ID NO: 376852 - DNA, 285 bp, Homo sapiens
tggtctgtctcttcccaccttccatctgcacacacccccaaggtaagggtacagcccggctggcggcctccttgggaacgtgtaggccacggctctgccaccactaggtactgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttgg

SEQ ID NO: 376853 - DNA, 3464 bp, Homo sapiens
gttcgagcccttggtggggacagctggggagatggcagtgcaggctggaacctgggctgccccagaacacagtccattacgatagaaacactaattgagcatgtgcgtggggtgggggtgtgtgtgcacatgtgagtgtgagtgtgtgtgggcgcttggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccccccagcacctcaaacttgcatggctgggctgtggcctctgcggccaggaagcctgacactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctgggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacgcacacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcggtgcggtcggtgcagcgtggccaatgcgcggcgcgcgcgggggacagagcaggaggcggtctgtcacctcggccactgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagtgctgctgccagcttatttttctggtacttgtattttcacatgttaaatgatctttatatatgttgaattaacaaatattttgagtttctgagaaaaaacaaaacatattaatggtattgaaatgtgttagtagtctggctgtgtgcccaaaattctgtttcgcagcaaaagtgaagacctgtatgtaaagaaagtataacaattatttctttgtattttaggggctttaaccggaacatcgtctagctggtgttaggaatgtttgcttaatttccagacttttttttaaaaacacatcgtgggttttttgaggctccaacctgattagtgcatggtcagccctcaatgaaggctgaggcatctctgactgaggtgtttttgtttggttttgttttttaaaatcatgtatttgctacaaagtattgtacttgtctcaatgggaatggtgtaaaaaacaaaaggccttatgtgatctgtatcatagttaataaatgaatcttgtaaaaaaccaaaaaaa

SEQ ID NO: 376854 - DNA, 808 bp, Homo sapiens
tggtctgtctcttcccaccttccatctgcacacacccccaaggtaagggtacagcccggctggcggcctccttgggaacgtgtaggccacggctctgccaccactaggtactgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagtgctgctgccagcttatttttctggtacttgtattttcacatgttaaatgatctttatatatgttgaattaacaaatattttgagtttctgagaaaaaacaaaacatattaatggtattgaaatgtgttagtagtctggctgtgtgcccaaaattctgtttcgcagcaaaagtgaagacctgtatgtaaagaaagtataacaattatttctttgtattttaggggctttaaccggaacatcgtctagctggtgttaggaatgtttgcttaatttccagacttttttttaaaaacacatcgtgggttttttgaggctccaacctgattagtgcatggtcagccctcaatgaaggctgaggcatctctgactgaggtgtttttgtttggttttgttttttaaaatcatgtatttgctacaaagtattgtacttgtctcaatgggaatggtgtaaaaaacaaaaggccttatgtgatctgtatcatagttaataaatgaatcttgtaaaaaaccaaaaaaa

SEQ ID NO: 376855 - DNA, 2941 bp, Homo sapiens
gttcgagcccttggtggggacagctggggagatggcagtgcaggctggaacctgggctgccccagaacacagtccattacgatagaaacactaattgagcatgtgcgtggggtgggggtgtgtgtgcacatgtgagtgtgagtgtgtgtgggcgcttggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccccccagcacctcaaacttgcatggctgggctgtggcctctgcggccaggaagcctgacactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctgggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacgcacacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcggtgcggtcggtgcagcgtggccaatgcgcggcgcgcgcgggggacagagcaggaggcggtctgtcacctcggccactgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttgg

SEQ ID NO: 376856 - DNA, 1057 bp, Homo sapiens
ctgcagatggagagaaagaaagacatctcagaagtctatggggacagcctacagctccccacagggttgctccaggtaacgctggaaggtgaaagctgagcaggctccagtccccatcctaggtatggaacagatcaaaccaccacaggcctatgtctgaccttgttcccaccccatgctcctctcccacctgtgtccttctctttgcaggagaagggacagacagaggttctcagtgatgagctcaggctctggaagggcacttgaagtttggctttagttcttcctttcccatataggggagctcagcttccagggtcctgggcctgctgtgacccaggttgttactcctgatataactgcttcctgggctctcatgatctcagctgagcctggctttctgctgatgatatttgtttgttgcttgccaggcaccagggtagataaaaagatcaccaagacccgcacctttttccttaggagggtctgagtcttcaggagacggagacatatggaatgtgtcggggttggaaggagcaggactggagggtcggggtgaggggggcagagggaaacagggccgtcagggttgcctgaggccagatcatacagggtctccaatgcagccaaggagagtggctttttgtgaatgtgcagtgcaacttttttttttttttgagactctgtcgaaaaagaaaaaaaagatgaaatgccttgaaaaagtaaggccaatgggtagggtcagaatatggcctgcaaatgcactgtactatttgtgtaacttatatgtaaatctgaaattatttcaaaataaatacaaaaagaaaaaaaggcaatatcccagaaccttgtgaaaacctggccgtagcaggtcctttttcctcctgctgagctgagcaggcatgctcacagatcctcaaggtttcttgaatggctactgtcctccccactggcccctctgccaacacctctgcccctcagcttttctgatgcccatgccccctcaccagctaactgtggcttgcacctttacctgttcccttcattttcccttctc

SEQ ID NO: 376857 - DNA, 435 bp, Homo sapiens
gtagggacagggtctcattatgttgcccaggctggtctgaaactcctggcctcaagtgatccttctgcctcagcctcccaaagtgcggacattataggcatgagccacgggaccaggacagaaaacaattttaaaatgacaacctccctgtgaaataaaacttgactggcacctgggtttgtatgactgtaaggattaaaaatggtcaagacaccctataaatagattaaggttccaacctaagtagaaacaatctggaaaacagaagtgtgtaagtttggacctcaattctgaaaatatactttttaaaaaacccgattttccaactcccaaacagattttagaaaccttaagagtatttttatgctggcttccaaaggttaaaacaaaatacactcatttcacctatgaatactgtcaaagcattataaatgc

SEQ ID NO: 376858 - DNA, 586 bp, Homo sapiens
atgttcttgaactgtaaaatgaaattataaagtatttacccattggtgtctgtcttcttgtactaaatattatgtgtgatttttccatattgttatatgtaccagtagtcttttaattttttgtgtacataatattcaaggttaaaacaccaaaatatatttatacattcttttgttgatgagcctttgggttgtttctagtttggatctattagaattagtgtacagaatattcttgtattcttcggctatattttaatacacatctggtatctatttcctattctggcaatatggtggtaagggtggggaattaagttatgtagggatgtgcttgttcagctctattttacaccattacaaagttatccttgcagttatgctaatattgacttctactatcagagtatgagaattccagttgttctacaccctcaccaacacttgaagttgtcagcctatttacatttagcacttctagtgagaatgtaattctaaaaaatgtttgttttgtttttaattttcttgatggtccattgaattgagcactttttaaataaaatgtttcttgtttcttggccattta

SEQ ID NO: 376859 - DNA, 2471 bp, Homo sapiens
  misc_feature (18)..(18): n is a, c, g, or t
aaaagggcattgagaccntgggaggtgacttcatcaatgctcctaccccgagttcttgagacagacctggaccgatcccctaccttgggtgtgcactcttgggagaacgaggggcggagggtccgaatctcctctcagcctttaagctcacctggtcagaatccttggatgagcctgtgggaccgttcctcctagcccggtggtttggaaccagtggctttgggactgtaagaggatggacaaaggtagtatgaggccgggacagctccccaaatgctcgggcgccaagcatctgctgattccactctgtgcctggcacgtgtgtctttcggtcctggctaggccttgccacctccccctgggccagcaccacccatgtacctgtcggcagagccacagttgactgacttgctgttgagctgctgctctttagcacggctgcattttgatggcagagggagcagttatgcccagagcccagcgtgtcggcatcaccagtctgacctgagcaccatgtgctgcacgacatgacacgtggcaccgggggaactgcccagcgtggaaggtctgggccaggtctgagcccagatgggatctggatggccaaggaactctaccttaaaacctcaagtgtcaaggaggcaggggaggggccaagagggctggcaggggaagggggctggggaggggtcccatttgcagaggctctaggatcttaggaggcccgaatccaccatttctctcttgctagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376860 - DNA, 555 bp, Homo sapiens
gaccgtggggtgagaatgggcttgcgagtttacccccacctccccagccaccagcctgtgggtctcaaaccaaggctacttggtgctctgctttgagttgcagaggtgacttcatcaatgctcctaccccgagttcttgagacagacctggaccgatcccctaccttgggtgtgcactcttgggagaacgaggggcggagggtccggtaaggaaggggcacagaccctacctcagtttgccggcaagctcgggccccttcgccctctcctcagatgtcaagattcttagtcgtagcctatggagcggagagcgacaggctcacctggggacagggctagaacactgagctaagagccaccctggttagaagtggggactcacgagaggagcgccccgagaaagtccagtacctgggttctctaggggttgttggggcacagcgtggttgataatcacgcagttcccaaacagtggtttttggtttccacgagatggtatctcatggaaataccacttactaaatcttcagtaaaaaccccaaatggaaaagaaaa

SEQ ID NO: 376861 - DNA, 1953 bp, Homo sapiens
ctagtcgtgaaccggaagtagacgtacctcacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376862 - DNA, 1748 bp, Homo sapiens
ctagtcgtgaaccggaagtagacgtacctcacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376863 - DNA, 2056 bp, Homo sapiens
ctagtcgtgaaccggaagtagacgtacctcacgtacctcacggaagccggctttggccctgcggctgctaccgtcgccgcggagaaattgttggatctggcagtctaggaatgaggtgacttcatcaatgctcctaccccgagttcttgagacagacctggaccgatcccctaccttgggtgtgcactcttgggagaacgaggggcggagggtccgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376864 - DNA, 2009 bp, Homo sapiens
gaccgtggggtgagaatgggcttgcgagtttacccccacctccccagccaccagcctgtgggtctcaaaccaaggctacttggtgctctgctttgagttgcagaggtgacttcatcaatgctcctaccccgagttcttgagacagacctggaccgatcccctaccttggaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376865 - DNA, 2046 bp, Homo sapiens
gaccgtggggtgagaatgggcttgcgagtttacccccacctccccagccaccagcctgtgggtctcaaaccaaggctacttggtgctctgctttgagttgcagaggtgacttcatcaatgctcctaccccgagttcttgagacagacctggaccgatcccctaccttgggtgtgcactcttgggagaacgaggggcggagggtccgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376866 - DNA, 1833 bp, Homo sapiens
ctagtcgtgaaccggaagtagacgtacctcacgtacctcacggaagccggctttggccctgcggctgctaccgtcgccgcggagaaattgttggatctggcagtctaggaatgattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376867 - DNA, 1418 bp, Homo sapiens
aactttcaacccaaagggcctggttgtttgaacacggaacaggacgttaaaaaccaagggccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376868 - DNA, 636 bp, Homo sapiens
taatcagatcattgagagtcttggtttcaatgtctcgggcatgataaattctcccgtcgcataggactggccgtcctttagtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376869 - DNA, 622 bp, Homo sapiens
  misc_feature (49)..(49): n is a, c, g, or t
  misc_feature (74)..(74): n is a, c, g, or t
  misc_feature (76)..(76): n is a, c, g, or t
  misc_feature (87)..(87): n is a, c, g, or t
  misc_feature (116)..(116): n is a, c, g, or t
  misc_feature (118)..(118): n is a, c, g, or t
  misc_feature (125)..(125): n is a, c, g, or t
  misc_feature (136)..(136): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (149)..(149): n is a, c, g, or t
  misc_feature (180)..(182): n is a, c, g, or t
  misc_feature (186)..(186): n is a, c, g, or t
  misc_feature (188)..(188): n is a, c, g, or t
  misc_feature (191)..(192): n is a, c, g, or t
  misc_feature (194)..(194): n is a, c, g, or t
ataaccatatttattttttccttttttttttattttccttcttttaatntatcccttaaataatttttcatcantnttaataacatnttttatttcttctatttccaattattttntncttcccnttttacatttnttttnttncgntnctctgtggcaccaaatggcgcctcagcaacnnntttntnttnnanatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376870 - DNA, 1503 bp, Homo sapiens
ctagtcgtgaaccggaagtagacgtacctcacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaaggtagtatgaggccgggacagctccccaaatgctcgggcgccaagcatctgctgattccactctgtgcctggcacgtgtgtctttcggtcctggctaggccttgccacctccccctgggccagcaccacccatgtacctgtcggcagagccacagttgactgacttgctgttgagctgctgctctttagcacggctgcattttgatggcagagggagcagttatgcccagagcccagcgtgtcggcatcaccagtctgacctgagcaccatgtgctgcacgacatgacacgtggcaccgggggaactgcccagcgtggaaggtctgggccaggtctgagcccagatgggatctggatggccaaggaactctaccttaaaacctcaagtgtcaaggaggcaggggaggggccaagagggctggcaggggaagggggctggggaggggtcccatttgcagaggctctaggatcttaggaggcccgaatccaccatttctctcttgctagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcggggagtgaaccctcctccagtgagaagaagaaggtgaggaattgggagacttaggggatgggaggtagtgccagatttcatgtttccccagaacctttgccagctgccaagagccctgcagagcaggctggtgagaggaccaagctgccccagccctcatctcagatgcccccctcctgggaacacacctctccctactccccatttcttgctgcagcccccacccccaaccctgccattgcatcctgtatcacattccgtgtgggaggcatggagcatgcatctattctgggagcagacagcctgttcccagcattgcagagtgtaaaaataacccccaggtggcattgctgtggccctagacactgcaccagcaagagtgatttcccggtatcctccccacccaactttcactctggggtcggggatactgccagcaaagagaagaccccgtatggtcaaggactatatagaagtaacttggtgggatgggggtgggtattagaaactgattagcctcagactcttcttttattgtttttcttttgtaaataaaaagcaccaggttccaaa

SEQ ID NO: 376871 - DNA, 221 bp, Homo sapiens
ctagtcgtgaaccggaagtagacgtacctcacgtacctcacggaagccggctttggccctgcggctgctaccgtcgccgcggagaaattgttggatctggcagtctaggaatggtgagacctcgcggttcgcctctgagggttctcagaggagttggggatgaaatggagttttgcagagtgccgccggggacgaccaccccccaagtttggggccccgcc

SEQ ID NO: 376872 - DNA, 2104 bp, Homo sapiens
ctagtcgtgaaccggaagtagacgtacctcacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgaggtgaggcaggcccatccccgcccttcttaggctgcttcctctgtcagtgcctttctctgcgtagtccttggtttcccatctttctctggcctgcatagacctactcccccaattcttcaggtcccagccctcacctgccccatttccccagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376873 - DNA, 1575 bp, Homo sapiens
ctagtcgtgaaccggaagtagacgtacctcacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatccctgggcagagcaccatgtacctgatggttgtggccctgtctctggagggtcgcctggaggtttcccggaaccgtgtcttcagcttgaacacacggggttcttcttggcagtggtcccggcccttctgatggggcgggctgggtcaagggcccacactgtggggtccgccggctttcttaaaggcgtgcctcggggcgcgccccagtgggcgggctcccgccgccacgtgactgtccgcgctcggcgggggacccctctcctg

SEQ ID NO: 376874 - DNA, 2459 bp, Homo sapiens
ctagtcgtgaaccggaagtagacgtacctcacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaaggtagtatgaggccgggacagctccccaaatgctcgggcgccaagcatctgctgattccactctgtgcctggcacgtgtgtctttcggtcctggctaggccttgccacctccccctgggccagcaccacccatgtacctgtcggcagagccacagttgactgacttgctgttgagctgctgctctttagcacggctgcattttgatggcagagggagcagttatgcccagagcccagcgtgtcggcatcaccagtctgacctgagcaccatgtgctgcacgacatgacacgtggcaccgggggaactgcccagcgtggaaggtctgggccaggtctgagcccagatgggatctggatggccaaggaactctaccttaaaacctcaagtgtcaaggaggcaggggaggggccaagagggctggcaggggaagggggctggggaggggtcccatttgcagaggctctaggatcttaggaggcccgaatccaccatttctctcttgctagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376875 - DNA, 1943 bp, Homo sapiens
gaccgtggggtgagaatgggcttgcgagtttacccccacctccccagccaccagcctgtgggtctcaaaccaaggctacttggtgctctgctttgagttgcagaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376876 - DNA, 1723 bp, Homo sapiens
aaagataggctagtagagcccggtgtatcggccgagggcctgccgtgcttcgtcgcgcggagaaattgttggatctggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaa

SEQ ID NO: 376877 - DNA, 1050 bp, Homo sapiens
  misc_feature (830)..(830): n is a, c, g, or t
ctagtcgtgaaccggaagtagacgtacctcacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagtgggctgtcaggccatgaggcagttggaccaagaggtattggaggcatncagaagaaggcctgtttagaggtggggagcaggtggggcaagtggatcagacagccggcacctgggacttcgggccggtgggaaaccggggtttacggcgacggaggcgaggcctggtcttagagtttcgcgggccaggctgcacggcgctgtcttgggcgtgtttcccgtggtcgttgtgcgcatggataggtttcccaggggggcggccgctctgtgc

SEQ ID NO: 376878 - DNA, 1051 bp, Homo sapiens
ctagtcgtgaaccggaagtagacgtacctcacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtgaggaattgggagacttaggggatgggaggtagtgccagatttcatgtttccccagaacctttgccagctgccaagagccctgcagagcaggctggtgagaggaccaagctgccccagccctcatctcagatgcccccctcctgggaacacacctctccctactccccatttcttgctgcagcccccacccccaaccctgccattgcatcctgtatcacattccgtgtgggaggcatggagcatgcatctattctgggagcagacagcctgttcccagcattgcagagtgtaaaaataacccccaggtggcattgctgtggccctagacactgcaccagcaagagtgatttcccggtatcctccccacccaactttcactctggggtcggggatactgccagcaaagagaagaccccgtatggtcaaggactatatagaagtaacttggtgggatgggggtgggtattagaaactgattagcctcagactcttcttttattgtttttcttttgtaaataaaaagcaccaggttccaaa

SEQ ID NO: 376879 - DNA, 547 bp, Homo sapiens
  misc_feature (486)..(486): n is a, c, g, or t
  misc_feature (504)..(504): n is a, c, g, or t
  misc_feature (513)..(513): n is a, c, g, or t
  misc_feature (530)..(530): n is a, c, g, or t
ctagtcgtgaaccggaagtagacgtacctcacgtacctcacggaagccggctttggccctgcggctgctaccgtcgccgcggagaaattgttggatctggcagtctaggaatgaggtgacttcatcaatgctcctaccccgagttcttgagacagacctggaccgatcccctaccttgggtgtgcactcttgggagaacgaggggcggagggtccgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccagttcatcaagangaagaattcgatgatganctggtgganagcagctggcatttctncgggcggtcggcggcgg

SEQ ID NO: 376880 - DNA, 736 bp, Homo sapiens
tctgtagagacagggtatcaccatgttacccaggctgttctcaaactcatgagcgcaagccatccacctgccttgatctcccaaagtgctgggattgtgctggcaggagccaccacacctggcttaaatgctcctcttgatggttggcctctttctctggcaatggctggctccctctgctcctcaggcacagggggtgagatgcacagtaacaactctgatccaatccagctggttctttttagaggaaaaacctatagctggagcagtcaacagaggcaaggtcaccttgtggcagctgcagctgcaaacatgggaaggaagcagggggcaggggagggcaggagatcatattttggaagagggtgctgggcagaccatccaataagggctaatggcagcccttctctaagaatgagaaatgtcattctgaccagcagttgacagttaagggtcatccaaatgagctacatgcttatcctaaaaggattggctagagacaaaagaggaagtgggttacacacttatccaaaaaggattggttagagacaaaagaggaagaagaaataaaagggactggctcatttcttctgaacttcctgtctgtaactttgtcaggcagagcctgaagtgctctgtggttcctgggctattgcccggcattagcaggactggagtttggctgcagagggaggcgagagtacaaaagatactcgggaagctgattgaaagccat

SEQ ID NO: 376881 - DNA, 260 bp, Homo sapiens
aagggagcctttgaaggtggttgtttaattttataatttttaattttttaattagtaaggcatgttggagttagcataaaacaacggagaagggtattaaaaacaaatacccttttaagaaaagtatggaaagtaaaagccccttccctactttttccacttctgttttatcaactttagccagtatctctatttaatcattcccactgtaggccaagaggaattcttttctttcatatggagtctccctctgttgccag

SEQ ID NO: 376882 - DNA, 4497 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctggccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcac

SEQ ID NO: 376883 - DNA, 5060 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaaaaa

SEQ ID NO: 376884 - DNA, 5150 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctggccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaaaaa

SEQ ID NO: 376885 - DNA, 5197 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctgggtgagtcagcatccccaatttctaccacatccagcactcctaccatcttgcatgtaccttccttcctgtccccggctacttgggagtcagcttcttccctctcccaactcatctccctcttctctcctggcttctagagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaaaaa

SEQ ID NO: 376886 - DNA, 3724 bp, Homo sapiens
  misc_feature (3651)..(3651): n is a, c, g, or t
  misc_feature (3698)..(3698): n is a, c, g, or t
  misc_feature (3704)..(3704): n is a, c, g, or t
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagctggttnaacttggaaagaagccccaagaaacactttggacttctttctggganaatggnggtcccccagggacccaaag

SEQ ID NO: 376887 - DNA, 465 bp, Homo sapiens
actcccaccctggccagtcgagggatcttagggctatcccgacaggtaagttcctacaacgaggctgggaacaatgtgatctctttggctgctttctggatgggcttttctgatcattcaaccccaggggggttgggggaaaactgtgaacttgtgctcccagctgaggctacagtctggatttattatcttgtctacctttctcctctccccgggacctggctaagaggcatcaaggtcataggttaaaaggaatcttaaataaggagtatagtgctggggtggatggaaaggggagaatgccaatggcctggcttggacttgggttaaaatggcaaaactcaggccaggtaaggtggctcatacctgtaatcccagactttcagaggctgaggtgggaggatcacttgagcccaggaattcaagaccagcctgggcaacatagtgagactccatctctacaaa

SEQ ID NO: 376888 - DNA, 123 bp, Homo sapiens
ccaccctcccgagacacgctgaacacaactcttcattacctccactcactgctcaggtaaccgaggcccagtcctggcaccctggacactaacctcctgattcatgaggaccctcacctcctt

SEQ ID NO: 376889 - DNA, 267 bp, Homo sapiens
tgctgtacagctgctccgggaacaagaggcccgtggcagagacctgctggccgtggaggcggtgcgtggctgtgaggtgaggccctagctccagtcactgctgctcaaactgcccagccctggcctcagaagccgtgtaggttggtgacaggagaaccaggctccaggtcagagggctccaggctctaatttctaaccagctgggtggccttgattgagtcactgaacttcactggacttcactttcctcatttgtaaataaagaag

SEQ ID NO: 376890 - DNA, 6078 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacgcccacttcatcaaggaagttgaaatggaaaaagattatgtgttgtcaattcaggtgaaagtcaagaaacatcagtggaaacaaaaatcttccttttattgaaaccattctacactatggaacatttttataaatagtaccagcggcattgcatagctttattttgaagcaagaaagagacttcaaagatcagcttattcaaccctctataaaaggatttatagattccttttatttaatagggtgattttctcatgagttttcaccatgtttaaaagacactgtgccccactctcatcccaaggtctatggtcaacttgactcaatgctcataactttcctcgctgattcctgcttatcctgctcctccaagcacaactgcatttcccaaaggtagatccagtaagcaatactctcaaagcacccaccctatgcacaccagtttccctcaagggactcaaaaggaatcgaggtagacccttctcagaggctgtttaactacagacacatcaggatatgtactaatacccaaaaccaaaaccaccaccaatgactgcaatagattcactgtctagacccaaggtccaggcagtttcccttttttgcatttccccaacatataaagataatttccaacatatcagatgcacattcaccagggttatttctggaaggtgaaggggtcaggtgtagaagaggtggcaagaatgacaagtctgtggaaaactgttggccttgagaccacagtgaactggtggaaggggacttgctaagtgtggccacaaggtggcagtcacctcctgaaaccccgtgtgaaacgtcagcggggttgagaaaggccacgtctccaagtttccaggagagccaaaccaggactcaggaaaaccggccagctgatttgtatgggagattgatttgtaaaagaacaacaacaacatatggcagcaaggaaatgcaaagcaaacatctacaaatatttgaatccacctgtccctcacctaccaacttccccctctaccactcataaagtggtaggactcctaatgccccgcttccttccacctgagaaccaaccagcaccctgatatttcaaagccagacctaaagaaccatggttgccaataacctcaatgccaaaccaaacaatcctaatcacatttttacttttcaaatccagtctcagagcagagctgtagattaagggacaaaaagtcattgtggaatcttttcaaatagctcttgtaaaagcatcagttgggaaagagtttatgagttcctctttgtcctctcctctggagaaaagacagaacatgcaagaacactagatacaccaagctatgggtgttgaaatagactagctggtgacctggatttgcaaataccctagggacatgaaaacattttttctttttctttttcttttttgtaacctccacccagaatttcaggaaaggtggggccacatgcccaggatatatggtattctactgcttgctttcttatcaccagaatactagtcaatctgatttcttagttccatgtcttttcttccaaggaggtagggcatggggttgggggacactttccaccttccttgcatctcactgtccactcttaaatttttattaagaaacctctgaaagattcaaaattcagttcagtttcaataatcccaaagaagttgggataatttgttttcacttgcttcaaacttgccacggctgcaggaggagtctcaggacctcagaggaatggggcagatgtgtgaagtctgggagtctgcctcccacccagatgccaggagctgcatactcagctctgcctcacttccctgatggtctgctttcatccaggttaccatgacagagagggtctatcctctaaagaaagctgagttacaggctggcccctggggttgttcctgtagcctctctttgaccacattcctgaagatgtttagctgaatgcctcctcaaacctttgcttcttccataacccaatcctacacatatgtgataaagctttcttcaacaatactgggtcatttggacactaccagtccagatgagaactcacagaccaaatgaaaactttcaaaagcaagcagggaaagtaactcctatatgctttaagatgatgtattggtgtagattcaggtccaatttgaaaaaatgtctctggttctttctaattgtatccactctggatttgtttatgccagttctacattcatcaagccttgagaaacaggtggaaagaagaaaaatataaaattaagaagaagctgatggatcattggagattcaaaacaagccttctaccggtggcaccacactgaaaggcagagacaaggcaggagcggccatgggagaggaagcagcattggcttctcacgttctggcctccagcctcccaccagagcttctgccattcacccacttaacttgaggagaaactaaggcaccaaggcctgtcactgcaccgaaaaccagaagcagaaggactttctttctttgctcaaccagttctgcctggatctgacttttgcgtcaccagtagtcacaagcctgatttgtcatctccagcattctgtttatttttttaaggtcaatctttgcctgaaacatgacttcattgcacctgcagcacttcattgtccaaatgtccttggcaaacctcacagtctttggacagtgttgcattttctccaaaggggaaatcctctctccttcctcaagcttaataaggctcttgcagtgcatccaaataacacagctcttgttcctcagacacactcagccccctctgataacttcataaaacagctccttattgtctgggccatgaagccaggctaatgctaaagttccagttcaaaaacatttaactctattatccttatgaggccagctctcctgggtactggcactcactcactggcaccatggattcaggtcaggtggtgcaaacatcttccctgagaagcaagccatacacccaacaggtctagaacacctaggtcacaagaaagggtttcagtccagatgcactgtcagtaagtgaacacaaggacaagaatgcatgaactgttattttcttcccatcactggtttagcagcccctagggagaccctgtgttgctctttaatattctgacatggagcactaatatgctcaacactgcctccaacaggcaaatgttggaaatacactttcagagctggatgggactcaagatcatctaatataatcctctcattttatttcctctcaaggaaaccaagggcaagaaagtttaggcaatttgctcacattcacacaggcaattagtaacagagctgagttcgggtctggtataggctttttaatttgattctccacaaatgaacactaagataaatagcatttattgcatacccactatttaccagatactgtgcaaagggctttacatatattactttactaaatcctcaccataaactttaagtcaggtttaaccattttatagaagagggaagggagggccaggaaggttaagtaacatgctcaaagtcacacagctactaaatagagccataatctgaacctttgtctaattttgaagcccttgatttttccacttcatgaggctgctctttatatttatttagctgagtgaccaccatcttggattttactaatattcttacaagggggctttgatgccacttcttctgacttttaagaaaaggaaattcttgcattatttttgccatgtactccaggggaccctcaatctcatcatcatggggaataagaaacattctgacatctctttccttttctttctttttaaatttggtagacgagggagagggtccccaacagaatgagagggggaagataagaaccagaacataaacccaataccccccaccccactcttttgggaacatcccaacattagaagagtgggatatccagtcatttttttcaagctggagcaggcagtgtagccaggattgaggaaggagaagccacagaataaacatggcacatgttctcagagcatcaattttactccagaatttgggaagaaaggattatattattagtgtattcaaaccagtatggatagcacaaatgcagatatcctataaattttgaggctaactccagcaggttgtagactgatttaggctacctccttccagactcccaggggtacaaacaccttcacagtcccctgcgggagtacatcagtggaaatatttggggaatgaggctagaaggcaggagatacattcagtttacttatccccctggtttcttttccccactccttacctgccccacatccctagtgggtgggaaggcatcagaagacagttggctacaatatcagctttctctgctactttggggaatttagaaggaaatcagtacttggcaacctggtatttttagctgccaggccaaaactccagacataaaccccttccctttaattgaatgatgtttatatataaaggaatagatctccccaagaaagaaccccagaacactggttccattccagtgtgggggctgcttgggcagcagtgacacctgtgcattagatgcaatagacacttcaattcctgcaaaaatgtcggccaactaagtgctcctttaccaactgcggaggcccagactcacaccatggtcccacagactcaaggtttagaatctatgtgagtctattttggttaacacacaggctcctccttccaatcattcacacacacacacacacacacacacacacacatgcacacacacacatgcatgcacacatacacaggtgcacatgcacaaacacacacatctaatgattccaacctcgaatactccccaggcccatggggatgcccaagtaccctaagcaaatcactgtgacactgagggggtcattaactggggctccgagcagctgaaacccaccctggtggtctctagattgttgttctgagaaatcataaacaccaaatcctccaatccctttgaatttgagtttgtcattttaacctttaacagccttttcaggtaaaaataacaaagaccaatttattgactttgtagctacaatgagcttgaaaaagcgcttacttaaaagaaagactggaaggaagaaaaaaaaaagaaaatggagtacatactcctcagacgatgcacactttaattagctaaaataaaaataaaaatgtacagaggaagggagaggaaaaaccaacttctctgatcctttcatggcactgtagctcaaagactggaatctctgcttgttaaccattgttaactagtatttttagtcctggttgcttttagcctctgtatagttccttttttaaacacattttctatacgttaataaaagatcctgaaag

SEQ ID NO: 376891 - DNA, 3225 bp, Homo sapiens
ggacttatcgggaggacgcactgaggtacacgctggacttcctggtaccagccaagcacctgcttgccaaggtccagcaggaagcctgtgtgagtggccgtgcatcactattctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaaaaa

SEQ ID NO: 376892 - DNA, 2498 bp, Homo sapiens
gacccacgcgtcgcggacgcgtgggtcgacccacgcggtcgcccacgcgtcgcggacgcgtgggcggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaaaaa

SEQ ID NO: 376893 - DNA, 5708 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctgggtgaggcacctctcaaggggtggctcccaacagctcggtcatggtggtgatgttcaggctgcttgctgctgagcaattcctttttctagccaagaagcccagttgccatgacaactatgtacagcttccccaccgctaaaagagccttccatctggttgctagggtgatgcttacaacagcctgttgctaagaagcacttcctctgtgcctctctctctagctcttcttgggtttctatggaaactgcctcagcttcctgttgtaccctcctggttcaccacggcaatccttatagtttcctgtcgcttcttccctggttgctctaatgatgctgctgacaatttcctgcctcttggtagggggttcccttgcaactggatcgctatggtgactcacagcttcctgttgctatggagctttttcttccctgatggagcagcttggttgcttaaggtaatctggagggattctgtactctgctctcaccctagcttccccttcagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaaaaa

SEQ ID NO: 376894 - DNA, 5845 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctgggtgaggcacctctcaaggggtggctcccaacagctcggtcatggtggtgatgttcaggctgcttgctgctgagcaattcctttttctagccaagaagcccagttgccatgacaactatgtacagcttccccaccgctaaaagagccttccatctggttgctagggtgatgcttacaacagcctgttgctaagaagcacttcctctgtgcctctctctctagctcttcttgggtttctatggaaactgcctcagcttcctgttgtaccctcctggttcaccacggcaatccttatagtttcctgtcgcttcttccctggttgctctaatgatgctgctgacaatttcctgcctcttggtagggggttcccttgcaactggatcgctatggtgactcacagcttcctgttgctatggagctttttcttccctgatggagcagcttggttgcttaaggtaatctggagggattctgtactctgctctcaccctagcttccccttcagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctgggtgagtcagcatccccaatttctaccacatccagcactcctaccatcttgcatgtaccttccttcctgtccccggctacttgggagtcagcttcttccctctcccaactcatctccctcttctctcctggcttctagagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaaaaa

SEQ ID NO: 376895 - DNA, 4852 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagagaggtgagggccagggtgctggggggtggcccccaggagtgaagaccttgacaatgaggatacaaaggggaggtatggtggaaagtcaggaaaggcatctcgtccccaaatcagtgggactggctgggaggccctctgtgagactgagggtcattccagggagccaagagggctttcccacaccagcaccccaccccccactccccactctctgcagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctggccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctgggtgagtcagcatccccaatttctaccacatccagcactcctaccatcttgcatgtaccttccttcctgtccccggctacttgggagtcagcttcttccctctcccaactcatctccctcttctctcctggcttctagagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcac

SEQ ID NO: 376896 - DNA, 5006 bp, Homo sapiens
actgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtccctcaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatggaccagcaaaaaa

SEQ ID NO: 376897 - DNA, 723 bp, Homo sapiens
caactgctgatttcaaccatactatcatttcaatggtttctatattcttgatctaactaccaaaaactggaagcttgttgcaaggtgtgtcctaacaaacatacaataaatgactcttcctgcatgctgcctgagatatgttgtaatttgaaatgtcttatcaaaaaattatacatgttataacccaaagttgaactggcaatatttttcatgtgtaaaattgatggtatgttaatatcaaaagcagaagcattgtttgtcatacatgtatgttatatgtgatgtttaatcgtgttaaactgtaatctgtgaagttttcattgcctgaactagtcaattctgtataaatcattgtcttaattgttttcctaatcttaccatatttcctaacactgaaatataaatgtttgtcaattagccattcatattgtattgatctttataaactttagtgtgactccattaaactaacctaaacaaaggaaaatcaaagctttccctgtcataggctcagggacattttacttacagccaaaatcatttattcattgaatcaacaagtatttattgagtatctactgtgaatcaggctctataccaaattttgggagaatgcttaagaacgagagaaatccaaaccctatattccccagtgagaatttttgaactctacctaaagtattcttctgtaacttccactgagttaagaaattattttgtttc

SEQ ID NO: 376898 - DNA, 917 bp, Homo sapiens
gccgtgtcactggctcaggctcagttgctgggtcaccagtagaatggacccttcctccacctcagttcagagcacagtgatgattcgtgactttctttcccaatagaacttcaaatctctgaagacggggggtggggggatgtgcttgagtgtttgtactcatggtcttgttctagaagtgacaaagctgggacacaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagttggcagctagagaggctggcttcccacatcaaggaactggagcccaagctgaagaagattctgcagatgaacccaaggatgcggaagttccaaggtgagggatctgtatacactgcccccttcctacgaccagaccaggaaaaatcatctgtgcaactggcccctcattccatatggggattagctgctgtctggcacctaaaattgagatgcttcttcatcatcagattctcagccctgacaacatacagaatcacctggtgatctccaaaaaaaaggctggctgggcatggtggctcatgcctgcaatgtcagcactttgggaggccgaggcgggtggatcacgaggtcaggagatcgggaccatcctggataacacggtgaaaccctgtctctactaaaaatacaaaaaattagccaggcttggtg

SEQ ID NO: 376899 - DNA, 1496 bp, Homo sapiens
gccgtgtcactggctcaggctcagttgctgggtcaccagtagaatggacccttcctccacctcagttcagagcacagtgatgattcgtgactttctttcccaatagaacttcaaatctctgaagacggggggtggggggatgtgcttgagtgtttgtactcatggtcttgttctagaagtgacaaagctgggacacaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagttggcagctagagaggctggcttcccacatcaaggaactggagcccaagctgaagaagattctgcagatgaacccaaggatgcggaagttccaagtggatatgaccttggatgccgacacagccaacaacttcctcctcatttctgacgacctcaggagcgtccgaagtgggtgcatcacacagaatcggcaagaccttgccgagagatttgacgtgtccatttgcatcctgggctcccctcgctttacctgtggccgccactactgggaggtggacgtgggaacaagcacagaatgggacctgggagtctgcagagaatctgttcaccgcaaagggaggatccatctgaccacagagcgtggattctggactgtgagtttgagggatggaagccgcctctctgccagcacggtgccgctgactttcctcttcgtagaccgcaagttacagcgagtggggatttttctggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactcggtaaaagcgttatacaaagtcataggagaaaaatatgggacaattcatgattatacttaatctaatttgattagtttataaattgagtcctaagtattaattattgccaccatccaactcattgagtcttatggttcacatcttgtttcctatagaaatattctgtattctgggatcaatttccaaatgcttttttatttctgtaagttcaaattaatgtattatagaagttatgagttaaataaacattggaatatca

SEQ ID NO: 376900 - DNA, 5706 bp, Homo sapiens
tttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattgtctacctcgatcgtacttccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatggacattctggtctacatctcctggcacatatgtaagagtttctctagggtataacctaggaatggagggtatgaacatgtttacatgcacaaactagctgatgccaaactggtaatgccaactgaaaacattgctgtcaatctgatgaatatgaattgatgtatcaatgagaatttcatttgcatttccctagtatctattggggatgaatatattttcatgtttctggggcatttgcatttccacttgttttttaaatattgtgtctgataattccaatgtctggattctttgtttatctgttgtttctgttggtttttactcatggtattttatttccttgtatgtcttgtgaatttttattataagcttgttctccttaaaa

SEQ ID NO: 376901 - DNA, 1755 bp, Homo sapiens
  misc_feature (1233)..(1233): n is a, c, g, or t
tttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggtaactttcccttgagtgtctgtgtgagcgcgctgcatgtttcaggcaagggtacatcagcatcatggcgattctgtccttacatttttatagcacttcatacttctcagtgcacttcatattattaatggtattcacaatactgatactaccttagtgatggatacatgggcgtgtaatgtactgttctctttccttttggggtacttttgaaattttccagaatgaaacgtggttttgaanaaaataataccttagcatttctagattttgcaccttggtacaaattagcataagcaggcaatttgttgattcattcacttgaaaatatttattgagcacaactgtgtgtcagtgaccattctgggcactaaaagattgctcatcttttgtgagctagaaaatatgtagtaagcccatacataggttactctttgaaagtaataatagctattaagaaaataaaacaatagtgtatttggagtgaagtgcgacttgagacagggtaacaggggaagcttctcagaggagatgacatctgaacagacactcaaatgatgagatcaggccctctgagggacagtcagagggaagtgtgttccagcagaaggagcaggcatgcgaggctgagaggggaacacatttggcttgctcagggaatggcaagaagatccaggacagggtgcgcatggggtgagatgggctcaaggaagtggacagggattaagctatgtggaccctgtgggccacaataaggaatctgga

SEQ ID NO: 376902 - DNA, 5458 bp, Homo sapiens
tttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattgtctacctcgatcgtacttccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggggggggccccggccccaatttcccctttaggggggggttttaaaaataaagggcccggtttttaaaaactttggactggaaaaaccctggggttccccaaattataacccttggaaaaaaacccctttttcccagggggggtaaatcca

SEQ ID NO: 376903 - DNA, 5652 bp, Homo sapiens
tttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaattccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatggacattctggtctacatctcctggcacatatgtaagagtttctctagggtataacctaggaatggagggtatgaacatgtttacatgcacaaactagctgatgccaaactggtaatgccaactgaaaacattgctgtcaatctgatgaatatgaattgatgtatcaatgagaatttcatttgcatttccctagtatctattggggatgaatatattttcatgtttctggggcatttgcatttccacttgttttttaaatattgtgtctgataattccaatgtctggattctttgtttatctgttgtttctgttggtttttactcatggtattttatttccttgtatgtcttgtgaatttttattataagcttgttctccttaaaa

SEQ ID NO: 376904 - DNA, 1054 bp, Homo sapiens
tttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacaggtaggaaagcctggagtatggattggctgtatccttactctctcactcctctgaaagtgtcagaaagattttttattttattattttttttttgagatggagttttgctcttgttgcccaggctggagtgcaatggtgtgatcttggctcactgcaacctccacctcctgggttcaagtgattatcctgcctcagcctcgcaagtagctgggattacaggtgtgagctaccatgcccagctaatttttgtatttttagtagagacggggtttcaccatgttggccaagctggtcttgaa

SEQ ID NO: 376905 - DNA, 5598 bp, Homo sapiens
tttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaattccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatggacattctggtctacatctcctggcacatatgtaagagtttctctagggtataacctaggaatggagggtatgaacatgtttacatgcacaaactagctgatgccaaactggtaatgccaactgaaaacattgctgtcaatctgatgaatatgaattgatgtatcaatgagaatttcatttgcatttccctagtatctattggggatgaatatattttcatgtttctggggcatttgcatttccacttgttttttaaatattgtgtctgataattccaatgtctggattctttgtttatctgttgtttctgttggtttttactcatggtattttatttccttgtatgtcttgtgaatttttattataagcttgttctccttaaaa

SEQ ID NO: 376906 - DNA, 4750 bp, Homo sapiens
tttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaaggtaggtggagtgaaggaaggcctggatgggaggccttgtgatcaaacaacaattggacagagtggagagcagctgggccctaagccttcatcatttggatggagggaaagggtcagggcacttcctctgccctggggaggtgtggggacacagtatcagagggaaggatagcagccagggatcacacagacttaccgcagctgtcggggccttctgctcagctcctccctgcctcctagccagctgaccagggcccctttcctataaggtccacagtatgcagagaggaagtcaggaaggaaacaagggggcggccaggcctggtgaaggaactgttgagaatagcagtgtggaggttgtccctgaaggaagaatggcccagttctcctcccagtcttcaaagtcaggcaccctccttaggtgctgttgttctccgaggacttggggtctgatgagcaaggacgctgaggtccagatcagagtctggctctcagctggtggcagacctaatctttcccttcttcacttctaaacaagcatttttcttttttctttatttttatttatttatttatttattttcagatggagtctcactccagcctgggcaacagagcaagattccatctcaaaaaaaaaa

SEQ ID NO: 376907 - DNA, 847 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgaaa

SEQ ID NO: 376908 - DNA, 1273 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgaaaaaaaaaaaaaaaaaaaaaaaaaaaaaaaaacaaaaaaaaaaaaaaaaagggggggggggctaaaaattatatcccggggggggccaaaatttatgaggggtacacagtttttttgtgccaaagaggggggcccccccaaaagggaggaggcgcgataatatataacacagcgcacgaggggcgcccagcgtattaacaacaacgcgcgcgggtggggggacaacaagcggccctcggggcgaatctctgggggagaagaaccccacacctccgggcgggggcgaactcttgggggcaacacatcccccatcaggagaaattaacgcccgcgggcacacacaacatgaggatggcaggcgggtcaaccacgacgactatgctgcgccgcgcaaacaatggcacaccggacatgattggacactatcc

SEQ ID NO: 376909 - DNA, 495 bp, Homo sapiens
ggcggtccaggcggaggaagcagcgtgcgcggcgggtgtggacgctcctggagcgaggcggggggcggcggcggtagatcctgaatgaataatataattggtatatgaggacattacggaaacagtatgctacgtcattcaagttgtaaagtggcgatatttgtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgaaa

SEQ ID NO: 376910 - DNA, 935 bp, Homo sapiens
taaagcactgttaccttaatttaagattttaggagttgggtttctgtccttttccacattaaaaatacctgataggaactgttaattaccctttccacaattaacaaaaattagaattgaatttcaatttaaatgtctttgcccaaacaaaagtgaaaataggttatttgaaaacaacaaaacagagcttactgtctagtgtactaataaaacaaacatcttaccagtatttttaattttaccagagctagcaacatggaccacagatatactggtgactccgctctcctctggccaagctacaaatcatcacctgaggcagagatgctactaccctcttctggggctcaactaccgatgggcatcagtaatccatcccagtataacatttcaaggatgtgctggagacaatacatggactttctctttcaatggtgaggaatgaaacaagatacaagaaccacagcatggaatatgttttcttttacatccaatggccaggtcataaaggatgccttgagacctccaccctggcccccacagcgctttgggacaggatgactaacgcagtccagcttcatgtgcaatcaagtcccgggaagaaatttacatttcaaactctgaaaaatcagtgtctaggttggcagcagtactctggaaactgataaaaccaaattcggtcctatatttcaatttccccttctaagttaatacatgattgctgcccatcatacagtacttcaaccctaaactacagcaatttctgtcaacatttctgttgtataaaagttccatgctttgaagagcctatgggagtagaaaaagtttctctagaaatgtcactgaactatatttgcaacctagttgctctatgtgataaatatatctgactatactagggattatgtgctttaaaaaaataattttgttcactg

SEQ ID NO: 376911 - DNA, 704 bp, Homo sapiens
agctcaccacatcctctgtctcccaggagaattgctcgaactgggaggcagaggttgcagtgagccaagattgtgtcactgcactccagcctgggtgacagagtgcgactccgtctcaaaaaaaaaaaaaagctcttgttatactatattgaatgatcctgcatggtttatttacataatgtaatatctatatgcacagcgtagatcctgaatgaataatataattggtatatgaggacattacggaaacagtatgctacgtcattcaagttgtaaagtggcgatatttggtaggaccttttaaacatgatacttaaaaaagtacatatatacacacatctgcaaaaactaaaaatcaccttattcataattagttattaataccttaaatagagcattccaaataaaagtgttaaattttggatgactatttagaaaaaaaaatggaatttatcatttcaatatggtaacattggttttatcatgctggttggaattctagttaaaagttatgtctttgattaataaaaggagaaaattgttaatggtgtgtgtctgtaggcaacagcttaggctttgccatcacacagcatctcactggtaaatcattaataattacaggccttatcataacattatgaaaattaaatgaattaaaacttataaaatgcttagtgtggtatctggcacatggtaaacactca

SEQ ID NO: 376912 - DNA, 772 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcagtgagtgtggggctggggatgggggcctcgccggcctgtagcggacagcgcgggtccctgggacgctctcaccttgactggggcgcctgaagaggccgcgtcccgaggcatgctgggacctgtagtccgcgtgtctcctgaagccgcgactcgaggagagggaccccgctggccggagggagagggagagacttcgctgggcagatgggacaccgtgtgcagggccgtcatggtagtaggggccgcctgccctcggg

SEQ ID NO: 376913 - DNA, 575 bp, Homo sapiens
ggcggtccaggcggaggaagcagcgtgcgcggcgggtgtggacgctcctggagcgaggcggggggcggcggcggtgaggcctagggagggcgcggtccagggtcccggtgcctggctgcggaatttagggtagagtctgttcggcagcctttaatcggagacgtcacgtggccgctttttaatgctgaaaaatcactctggctgcagggagtggaggctgtcgcccagagagagcgccgtcggtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgaaa

SEQ ID NO: 376914 - DNA, 439 bp, Homo sapiens
gatgagaaacattagcgttggttctaggatgtaactcagaggagttttggatgacttaacgctttgagaatgtagcacgctgtctgccatgttgttttgtcttgcagtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgaaa

SEQ ID NO: 376915 - DNA, 930 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattcttctcaataaagctttataaggacaattctaaggccagaatcagatgaaactttaaaggctttgaacttctgggttagttttttccccatgacggtggggaaattttaaatccatactc

SEQ ID NO: 376916 - DNA, 720 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggcactttccgtatcctgatccttcccaatggacctaaatggacaatggacctaaatgga

SEQ ID NO: 376917 - DNA, 761 bp, Homo sapiens
ggcggtccaggcggaggaagcagcgtgcgcggcgggtgtggacgctcctggagcgaggcggggggcggcggcggtgaggcctagggagggcgcggtccagggtcccggtgcctggctgcggaatttagggtagagtctgttcggcagcctttaatcggagacgtcacgtggccgctttttaatgctgaaaaatcactctggctgcagggagtggaggctgtcgcccagagagagcgccgtcgggtgagaggagcagaaagccggaagccaacgctggggcagccgtggcgtttaggagagtgacaggcagagccgcccgcgaggtggcccgagacgcagaccggagggcggagggctgggggtgcgaggtagggaagcagttggcggaaagccggagttagtgggtgtggcagaagaattccccgtacagagccaggactgggaacaagagtcattggattgattccccagggtcccctttaagattccatccaaggtttaccacttttaacccaaagaagggcagtggttgggggtccgtggaatccccaagcgggggaattcctgggggccgcacaagtgggctggcggtttcagaattcccgaccttctgccacaactccaagctggtgggaaccttgggacaacagtttgcttattcctcgttaatggccttccagtttccttcaacccaatttgggcgtcccatttgcaagggaaactacaatgaagttactggttaaacacaatacatcaagacg

SEQ ID NO: 376918 - DNA, 810 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcagtagatcctgaatgaataatataattggtatatgaggacattacggaaacagtatgctacgtcattcaagttgtaaagtggcgatatttgtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggcactttccgtatcctgatccttcccaatggacctaaatggacaatggacctaaatgga

SEQ ID NO: 376919 - DNA, 1453 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagctagcaacatggaccacagatatactggtgactccgctctcctctggccaagctacaaatcatcacctgaggcagagatgctactaccctcttctggggctcaactaccgatgggcatcagtaatccatcccagtataacatttcaaggatgtgctggagacaatacatggactttctctttcaatggtgaggaatgaaacaagatacaagaaccacagcatggaatatgttttcttttacatccaatggccaggtcataaaggatgccttgagacctccaccctggcccccacagcgctttgggacaggatgactaacgcagtccagcttcatgtgcaatcaagtcccgggaagaaatttacatttcaaactctgaaaaatcagtgtctaggttggcagcagtactctggaaactgataaaaccaaattcggtcctatatttcaatttccccttctaagttaatacatgattgctgcccatcatacagtacttcaaccctaaactacagcaatttctgtcaacatttctgttgtataaaagttccatgctttgaagagcctatgggagtagaaaaagtttctctagaaatgtcactgaactatatttgcaacctagttgctctatgtgataaatatatctgactatactagggattatgtgctttaaaaaaataattttgttcactg

SEQ ID NO: 376920 - DNA, 1169 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcagtgagtgtggggctggggatgggggcctcgccggcctgtagcggacagcgcgggtccctgggacgctctcaccttgactggggcgcctgaagaggccgcgtcccgaggcatgctgggacctgtagtccgcgtgtctcctgaagccgcgactcgaggagagggaccccgctggccggagggagagggagagacttcgctgggcagatgggacaccgtgtgcagggccgtcatggtagatcctgaatgaataatataattggtatatgaggacattacggaaacagtatgctacgtcattcaagttgtaaagtggcgatatttgtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgaaa

SEQ ID NO: 376921 - DNA, 937 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcagtagatcctgaatgaataatataattggtatatgaggacattacggaaacagtatgctacgtcattcaagttgtaaagtggcgatatttgtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgaaa

SEQ ID NO: 376922 - DNA, 839 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattctccactgggatcctctagaaccaccacc

SEQ ID NO: 376923 - DNA, 1134 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaaggtctcattctgtcatccagactggagtgcagcgtgatcatggctcactgtaaccccaacctcctgagctcaagtgattctcccgcctcagccttctcagtagctgggactactactcttggctaatttttgtatattttgtagagatgaggttttgccatgttgcccaggctgatctcaaattcttggactcaagtgatccacctcttggcttcccaaagtgttgggattacaggtgtgagccagtgtacctggccaacaaatttgttttaatgactggactgtaaacccttgagagaggaagggtgattttgcttctcttgtctacaaggctgtcacatgatcagtgctcaataaatacttgaataat

SEQ ID NO: 376924 - DNA, 1201 bp, Homo sapiens
tgggaggcagaggttgcagtgagccgagatggtgtcactgcactccagcctgggtgacagagcaaggccttgtctcaaaaagaaaaaaaaaaaaaaaaaagaattatacaccactcagttttaggaggggcagaacacggggagagccctacaggatcagaggggcaaccaacaagctgtttcagaaggcatggggcagctcagcaaccataagttatgcgtgggctttgctctcgggagagaggtttcctgcagccgaaggactcacagctaatctgggtcaggagcggctgccggctcccccactcctggagatgagcgactctgtgacgtcacgggaggcgcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagtgggtgtgctccaaatttctttatgtcatatttaccttttttcataaacattagtttttactttgtgcctatgatggacttgaaaaaactgcatattctaacagcatgaagttgagttaaccatgtcctgtatctgcttttttttttttttttgagacagagtcttgctctgtcgcccagactggagtgcagtggcgtgatctgggctcactgcaacctctgccttccaggttcaagtgattctccttcctcagcctcctgagtagctgggattataggcacatgctaccacacttggctaatttttgtatttttagtagaggcagagttttgccacgttggccaggctggtctcgaacttctgacctcaagtgatctgcccacctcagactcccaaagtgctaggattacaggtgtgagccaccacgcctggcca

SEQ ID NO: 376925 - DNA, 429 bp, Homo sapiens
aataaggctgaatgtcttataataattcttagaggtaaaaactgtgtgccctcttcctccagaggctagtggcagtagtggagaattactcaatcctttcttagtaatccatacacacattatagacagcaggatagcagtctccctttccagaaacactgtataagaagcttctttccataaacagtttatacatcaatgtgtatagatacctagttactgtagatctttttatgttaggcattcagatgtgtctcattctgactgcgtaacattgatgtacacctgattttgttaagaccagtttgctccttttgggcaggtgctgcaggaaatacccttggaacagtttttgcttaaatatttgtatgtatctggaaggtacatttctagattccctgtgtcagtaaacatttttcagttgataaa

SEQ ID NO: 376926 - DNA, 645 bp, Homo sapiens
atgtcgcagaaattctgacatccactttcatatagatcttatacattttaatagtctctaatagcattcttctctgttttcctatagtctccaaacctttttcactttcttcttttttctctttgtgtgagtgtggatttctttatgctgaaacattccagctgatggtatttctcttatctttttggcttgtcatagttgatatttatccttcccacctcagatcaggaagaagctaaatgccaccttttgcattgtctgtctctcaaagaaaggatgcatatttgatttttcttctacaccgaatggagaatattacactgaccctgcttggaaactgagtgattctcctagtgcttgttctttcccaaaagagaactgtggactctctctctctgtgtgtgtgtgtgtgtgtgtgtgtgtgtgtatgtgtgtgtgtgtgtgtatcttcaattcttttaccttcaagaaacccccaaagaaaaatcaaacaatagtctttccttaatcaagcctattaagcagctttgccctcatatgtttttagacttaaaagtcttatatctaaattctttccagataatgtaaaaaaaaaaaatgatgtcactgtttatgttggcagcggcaaggtgctctatttatttc

SEQ ID NO: 376927 - DNA, 424 bp, Homo sapiens
atcatttttacagtgcctatctctaggtagtaggataatttttatttttccctttgtcttttattgtagtttctcagttatttccaataagcactgcattagttttatagttgtaaaaaatgttgtttaaaagtcagggagcccaggcgtggtggctcatgcctgtaatcccagcactttgggaggctgaggcaaactgatcacctgaggtcagcagttcgagatcagcctggacaacatggtgaaaccctgtctctactaaaaatacaaaaattagccaggtgtggtggcacatgcctctaatcccagctactcgggaggctgaggcaggagaatggcgtgaacctgggaggcggagcttacagtgagccgagatcacgccactgcactccagcctgggctacagagcaagactctgtctcaa

SEQ ID NO: 376928 - DNA, 876 bp, Homo sapiens
caagattgtgcccgctgcactccagccgtggagaacagagcaagaccctgtctcaaaaaataataagtaaaataaggccagatgctgggattacaggcgtgagccactgcacccggcctctgtttactttttgtacaacggtgatagcagctcttaagtatatccatttgactggatcataaatcagtacactgccagtgagatagtggtatatgcttatttgtaagagaacaacaaatgatatataaaatactagttctagggctaagttcactattaatctaatttaatttgtgactaaacactctggatagacaaaaaagtattctttgatatgacatgttgcaaaagtcacctgtagctatgactatagttgagtgttcttaatagcaaagataactattcaaatttttaaagttcttatttaggctatttgatgataaagggatgtacctgtaaaaatatatatatatttataaaggacctaattaatttttacaaaaggattttgttttgtatagtactaatctgcaaatgagcttccctagctggaatggaggtttgagagatagtatagtatagtggttaagaacaccgattctgctagtctgcttaggttcaaatcctggttctactacttactagctgggtgactgtgggtaagatatttaacctctctacttccgtactctgtaaagggataataacagtatctacattttggggtggtaatgattaaatgagttactacttgtaaaatgcttacaacaaggcctgccagaccctgacacatagtaaaagcagtatatgtgtttttttgtttttgttttttgtttttaataaaataagtatctgaaaaataaagtcactagaaaa

SEQ ID NO: 376929 - DNA, 891 bp, Homo sapiens
cgagggactcactggtgcctgccttggggctccgggactgtgggctgtctccatccggagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgaatgtagtcaaggtgatcggtctccgtccagcggaaaagacggaggccgaggtt

SEQ ID NO: 376930 - DNA, 2235 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgaccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376931 - DNA, 1798 bp, Homo sapiens
ctgggacctgctctgggcaagcacaggcgccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376932 - DNA, 1794 bp, Homo sapiens
aaggtgtacgcctcggttaccgggaccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376933 - DNA, 1803 bp, Homo sapiens
acaacgggcaggctgtactgcccggaagttatggccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376934 - DNA, 2511 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgagtgaggtggggaaacacagatggactttggggggctcccccttctacaggaaacccggagtggactggaacggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376935 - DNA, 1882 bp, Homo sapiens
ggagattcaggctgtggggccaagcctggcagagcccacagggcagccagggcatctcccaatgcctgtcctgacccccttaggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaaccgagcttggaaaagtcagacagacctctgaggtctcatcctggagctgccaccagcccagcctccctgggacctgtcttcactgcctggggccctgggagccagggaggctccctgaggctgagtgaacactgggcgctgcacctggctctcccacgtcctcggccccactcccgcaggtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376936 - DNA, 2326 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgagtgaggtggggaaacacagatggactttggggggctcccccttctacaggaaacccggagtggactggaacggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376937 - DNA, 895 bp, Homo sapiens
cgctggggctggtgtttctggtgtacatggtgggggctcccagttctctgagggtcctgagtctttcaagtacagccacggtagctcaggaaagaacccaccccctcaaactgaaagcagtaaaatgaacccgagaacctggagtcccaggggggcctgagcaggcagggtctccacgattcgtgtgctcacagcggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376938 - DNA, 2094 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgagtgaggtggggaaacacagatggactttggggggctcccccttctacaggaaacccggagtggactggaacggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagatattggttccccctgtgacctcaggggaagaggtcacctggaggctggtgcccacctgagtccaggcagacagaaaggggaaccagacccagaggtggcctttgagtcactgagcgcagagcctgtccatgcggccaacggctctgtccccttggagcctcatgccaggctcagcatggccagtgctccctgcggccaggcaggactgcacctgcgggacagggctgacggcacacctgggggcagggcctgagcctacagggaggcacagggcaggtgggctagccatgaacagaagaggaagctggagtgctttgggggttcatgcatgtaggctgggatttggggctcacacctcaacctgcatgcccagttccatgcccctcccctcttgtgaaagcacctgtctacttgggctgaggatgtgggggcacaggtggcaggtgaggctgccctcaggaggggcccaggcccagcttgtaccccacctccaccagtacctgaagaagtggggctctcaccctacctgcctctgccattggaatggcctggtttgcacagatgggaaacccgtttgcggggtgggtgtctgggtgggcacgtggggcgaggacctgcctgcgggaccctgccctggaactgacagtgcaagctcggcgtcctgcccatctgggcagaaggctggtttctcccatcaacgaagccctcccaggaccttcctgcaagccctcgtcccacacgcagctctgccgtcccttggtgtccctcccggcctcaggtcctccatgctgggtacctctgggcacctcgtttggctgagccaggggttcagcctggcagggcgccctggcagcagtccttggcctgtggatgctgtcctggcccgtggatggtgtcccggcctccacgtacccc

SEQ ID NO: 376939 - DNA, 1572 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgagtgaggtggggaaacacagatggactttggggggctcccccttctacaggaaacccggagtggactggaacggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccaggtaagaggccagcacagccggcccagcctccgcttgggcagcctggatgcccccgcaccctgcaccctctctccatggccacagtgccccaggaaggccccggctgccccaggccaggtcccaaccccatctccatggatgcaccctgcaggggacgccttgaggtcagcctccggcccccgtccacctctgtctcacctctcactttgtcaccgccaggtgggccatcctgagcttggcgactgacccttatccctcgtccttggctcctctggtgcccggggtgggtgcccagacctctcctgtgcccacgtccctagctgcaaagtggaatgggatggtgctgggactctccggccggcactcgggcctgctgcttccccacagggcttct

SEQ ID NO: 376940 - DNA, 2563 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgagtgaggtggggaaacacagatggactttggggggctcccccttctacaggaaacccggagtggactggaacggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376941 - DNA, 1947 bp, Homo sapiens
tcccgtacactctccgagacatcggcacgggtgcccaggctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376942 - DNA, 2011 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacggccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376943 - DNA, 1829 bp, Homo sapiens
cgagggactcactggtgcctgccttggggctccgggactgtgggctgtctccatccggagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376944 - DNA, 2414 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgaccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaaccgagcttggaaaagtcagacagacctctgaggtctcatcctggagctgccaccagcccagcctccctgggacctgtcttcactgcctggggccctgggagccagggaggctccctgaggctgagtgaacactgggcgctgcacctggctctcccacgtcctcggccccactcccgcaggtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376945 - DNA, 2471 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgagtgaggtggggaaacacagatggactttggggggctcccccttctacaggaaacccggagtggactggaacggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcgaaaccaccggagcccggaggcttgggggctccgccctgggctggcttccgtctcctccagtggagggagaggtggggcccctgctggggtagagctggggacgccacgtgccattcccatgggccagtgagggcctggggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376946 - DNA, 2179 bp, Homo sapiens
cgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccacggggagcagccgagggtccctgagtgtgtgagtgaggtggggaaacacagatggactttggggggctcccccttctacaggaaacccggagtggactggaacggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagatattggttccccctgtgacctcaggggaagaggtcacctggaggctggtgcccacctgagtccaggcagacagaaaggggaaccagacccagaggtggcctttgagtcactgagcgcagagcctgtccatgcggccaacggctctgtccccttggagcctcatgccaggctcagcatggccagtgctccctgcggccaggcaggactgcacctgcgggacagggctgacggcacacctgggggcagggcctgagcctacagggaggcacagggcaggtgggctagccatgaacagaagaggaagctggagtgctttgggggttcatgcatgtaggctgggatttggggctcacacctcaacctgcatgcccagttccatgcccctcccctcttgtgaaagcacctgtctacttgggctgaggatgtgggggcacaggtggcaggtgaggctgccctcaggaggggcccaggcccagcttgtaccccacctccaccagtacctgaagaagtggggctctcaccctacctgcctctgccattggaatggcctggtttgcacagatgggaaacccgtttgcggggtgggtgtctggtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaataaaaaaaaaaaaaaaacataaaaaaaaaaaaacaaaaaaaaaataaatataaaaagaaccattataaaatttatccttatattaattctattaaaaaatacggggcggggttttacaatcttggaaggggaaaaccctggggtacccacttaaaccgcttggaacaaacccctttcccacgggggttaattcaagggccgcactatgccctttccttggcacacctgtggggtataggcatttttgcgttttttttt

SEQ ID NO: 376947 - DNA, 339 bp, Homo sapiens
ttctcctagaaacctgggataagactggaattttgtgattccccaaaggggcttagaaaaagaggcctctgaattcccttagtgagattgcatttgcccctgtgttgcaaaggtttgtctgatcttgctggccttgcgttgttgttctgaatcctcctttcagtctctccctttgagaaaggaccactctttgcacctagagagacccagcgaggtttcctcctcctaaatcagtttttctggccagttggtccctagcccctaggaacataattgaattgctgtaccttttagctggtttgtcactgtttgagggagtgtctgacctgattagagatg

SEQ ID NO: 376948 - DNA, 242 bp, Homo sapiens
aattcaagcttctaacgatgtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376949 - DNA, 3735 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaaaaaaagacacaaacaaaaaaaaaaacagtaggagacagaggaccaaaaaaagtacaacacgacgatggagagcgagcaaaaggcaaagacg

SEQ ID NO: 376950 - DNA, 3529 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacagtcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376951 - DNA, 3561 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccggtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376952 - DNA, 2864 bp, Homo sapiens
  misc_feature (94)..(94): n is a, c, g, or t
tgtgcatacaaactggtgacctgtcaatgttcaacgtggtggtggcactagcagcacacataacgctgtgaccgatacgtatcagtaccaattnatatgtctaactgtatgcacgcgctgctctagatatgtagcgaagacatctcgcgacgatgcgcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376953 - DNA, 2704 bp, Homo sapiens
aaatggaacgaacagaaatgaacgaacaacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376954 - DNA, 2603 bp, Homo sapiens
aagtcgccgtcaccgttgggctgatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376955 - DNA, 3136 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaatgagttttatcctctagagtcagctatgaccat

SEQ ID NO: 376956 - DNA, 1483 bp, Homo sapiens
ggacgcgtgggtcgacccacgcgtccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376957 - DNA, 2108 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376958 - DNA, 2366 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgaccagggggatactctagagcgagccagcagcatgcacggtgcac

SEQ ID NO: 376959 - DNA, 1805 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtcaaaaaaaaaaaaaaaaaaaaaaaaaaaaaaaaaaaaaggggggagaaaaaaaacaaagaagcaaaaagagaggcaggaaaaaaggggaacgaacagcaacagcccaagccgcacaccaactcagaaccagacgcgccagccaaatcaatacgcaacaccaacagcgcaaccgaggcaacctctcgcaatggacaacgccccaaaccggaggcacccgccacagcgaaacacacaaacacgaaccgacacgcgctcaaggaaagacggcccacgaccaggcaacaccgctctccaacaagacacaccccaccggtggcgagaacgcacaccacacgcaagaactcccgaagaacaacagacgcgacaacaaccccccggcagacccgcgccaaaa

SEQ ID NO: 376960 - DNA, 1474 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctcgatttcctatgtcatataaaatcgaggggtgaggtactgttgtcctggctttactctgcaa

SEQ ID NO: 376961 - DNA, 1112 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtcactcttcaacaacttctgccctaggcctaggagaaagaataagcaagcttccttgacctgtagctctgtccttataatagacctgcgttcaaatgcaaacacattctaagagtctttcagtactcctgtatcacgcccatagcatctggcatcaggttaccctgtacagtcaacggccatagaagtcgccagcag

SEQ ID NO: 376962 - DNA, 130 bp, Homo sapiens
ggctatgggaatggcagttcctaggtgtccattctggctaaaggatattttataactgacaaaaactgcatagtggttccccacttgttcccacaggtgcataagctggagcctgaggcgtggaaacacg

SEQ ID NO: 376963 - DNA, 3644 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376964 - DNA, 3922 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaactttctggagtccagtttggtgatgtccattttccagctgtatgtatcctcaaacttgcactgataaccgccattttaccagggcaggattaggaagaggtacaaaggtgtgtctgaaaatttttgcacgtggatttctgcatataatagtcccgtgtcagtttacttatgcaaacattgcacatctgaattgtaattcggccgtttcctactgacaggatgtccttttgcttttgtctgcctcctcttcacatcttcctctttatccaccctaccaa

SEQ ID NO: 376965 - DNA, 2911 bp, Homo sapiens
  misc_feature (22)..(22): n is a, c, g, or t
  misc_feature (45)..(45): n is a, c, g, or t
gactctagaggatcccatcgangatcagtacggcgaggaccttgngcccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagacagaa

SEQ ID NO: 376966 - DNA, 1172 bp, Homo sapiens
tggttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgcgcgagaggggttatcagagacaagattcgataggatgaaagaacgagtagcgaagagagaacgcgatcaaatggaacgaagggagatcagtaaagggagaacgagcagaggacgagaagcggcccgtaaatggccgcacatcttgggaagagcggaggtgaacaggaagaccccaggagcaccatcctgcaaaaagacacggc

SEQ ID NO: 376967 - DNA, 4908 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376968 - DNA, 526 bp, Homo sapiens
ggcagagattgagccagaaggacagtccgtcgcgctaaaggagcaggctaaaacccatggtggcgacagctcactcgctgtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376969 - DNA, 476 bp, Homo sapiens
ttgttgttactggtctaacctgcttgaactagtctgctgtcctgtcaaatgcatctttttatttacatgtcccttaaattaaagctgatcatgaaagtaaaaaaaaaaaaaaaaaaactgctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376970 - DNA, 638 bp, Homo sapiens
aagcaggaaaaaatatgtagggtataaaatgtttattatattaaactgctgaattacccaaatgtctgtaagttgtcagctgaaagaaccaaaaagaaaaaaaaaaaaaaaaaaagcctgttctagaaacctgtggtgatgtagatgtgtggggaccctggggcctctgaaggcctcgtctcgggatgacaagctggcagtgtgcctatagagctcccatgggtatcttgctttcccatggggaggcattagtttgtcactttccgtgcgagttggcgatgtggttagtgtttctaagctgctacttgctgtgtatctgttcaccctgcagagctgccaaacggaggcccgaagaaaaagaacctgaaaaagtaaatccacagatttctgatgaaaaagacgaggatgaaaaggaggagaagagacgcaaaacgacccccaaagaaccgtaagaatttattcttgacattatcgaaagcagatggtaatgttaaaatgatggttctagaacaaaagggaaggggtttcagtaattgccagagcaaccttaggctcattttggatcgggttggtgaacataggaccaaggtgcgtcaggcaggatgcccctgcggtgaagagccactgtgaccacgcgc

SEQ ID NO: 376971 - DNA, 5175 bp, Homo sapiens
cccagccccagccgcggccgccctggggacgcagacgccaaggcccctccggccagggccgggagccgggccggcctagccaggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376972 - DNA, 5293 bp, Homo sapiens
cccagccccagccgcggccgccctggggacgcagacgccaaggcccctccggccagggccgggagccgggccggcctagccagggtctgactctgtcacccaggctggagtgcagtgacgtaatcacagctcaccgcagccttgacctcctgggctcaagccatcctcccacctcaatctcccaagtaggtggaactacaggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376973 - DNA, 5366 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376974 - DNA, 4626 bp, Homo sapiens
cccagccccagccgcggccgccctggggacgcagacgccaaggcccctccggccagggccgggagccgggccggcctagccaggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376975 - DNA, 5453 bp, Homo sapiens
  misc_feature (5431)..(5431): n is a, c, g, or t
  misc_feature (5433)..(5433): n is a, c, g, or t
  misc_feature (5435)..(5435): n is a, c, g, or t
  misc_feature (5438)..(5438): n is a, c, g, or t
  misc_feature (5443)..(5443): n is a, c, g, or t
  misc_feature (5446)..(5446): n is a, c, g, or t
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccaaaaaaaaaaacaaacaaaaaanananaanaaaanaancaagaaa

SEQ ID NO: 376976 - DNA, 5511 bp, Homo sapiens
  misc_feature (5489)..(5489): n is a, c, g, or t
  misc_feature (5491)..(5491): n is a, c, g, or t
  misc_feature (5493)..(5493): n is a, c, g, or t
  misc_feature (5496)..(5496): n is a, c, g, or t
  misc_feature (5501)..(5501): n is a, c, g, or t
  misc_feature (5504)..(5504): n is a, c, g, or t
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccaaaaaaaaaaaaaaaaaaaaaaaaaaaaaaaaaaaaaaaaaaaaaaaaaaaaaaaaaaaaaaaaaaaaacaaacaaaaaanananaanaaaanaancaagaaa

SEQ ID NO: 376977 - DNA, 5359 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376978 - DNA, 5318 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376979 - DNA, 2167 bp, Homo sapiens
  misc_feature (22)..(22): n is a, c, g, or t
  misc_feature (77)..(77): n is a, c, g, or t
  misc_feature (101)..(101): n is a, c, g, or t
aagaagagaaaaggcaaggaanaatgagaatgaaataaaaataagggtaaaaaagttataaaggaatgagaaaaaanaaaagtaaaataaagagagataanaagaagaaataaaaatgatataatggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376980 - DNA, 3656 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggtcagcagaggcctctgttcttccacgaggccacagactcttctagaaggctctgcctgaaacaaggttgtggcatagcacccacagttgttctaagagttaggttgaagtagctgtttttccaagtgtttctgattatcggtgggcactgataatgactagaattctagttcccagccctcacttttaggtccttattttaatgttgcagagccctttttccaaaagaaatccttaagctggctgggcactgtagctcacgcctctaatcctagcactttgggaggctgaggcaggaagatcacttgagtctaggagttcaagaccagcttgaggaaacgtagtgagacc

SEQ ID NO: 376981 - DNA, 3603 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaagtaagtgccccctcggagcagccggggccagggcgctccaggctgagccaggctggctttgtggtgtccccctccttacagacattgccaatccctccgcaccagctgttgtcctagccgtcacgttggcataggtgggcaaacagacaacataaatcgtgtagactgaccatgatgctattgcagagcaaagctgagcgtaaaagtcaactcgctggtttggctgggtgtggtttctcacgcctgtaatcccagcgctttgggaggccgaggcagtggggaatcatctgaggtcaggagtctgagaccagcctggccaacatggtgaaacctcgtctctactaaaaatacaaaaattagccgggtgtggtggtgcgcgcctgtagtcccagctactcgagaggcagagacaggagaatcacttgaacctgggaggcagaggttgcagtgagccaagatcatgccactgcactccatcctgggcaacagagtgtgactccgtctcaaaataaaaaaagaa

SEQ ID NO: 376982 - DNA, 2694 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccatatgcatcaaggaggcagatgacgatgacggacgtcgcgatactcccagagatgcgcggccaagcaaaatgccaaggaagaacgagcacccgacacggatcgcacccctgcgtcgacacaccggcggacggctgggaacagcgtcacatacacaacggcgcgatgacggcgaaactggactgccgacgggcacgactaccgcgacaccaaacgagatagtgcatctcttgtcaatgcgagtctaggattcaaccacggctacggcgacaagctcggcagactacagagattgagaagggtacgtaacacacatgtacccgaaaaccgagccacgcaacacaacagcgcgacacaactgcgtcgtccgtcaccgcggccgc

SEQ ID NO: 376983 - DNA, 2020 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagacgagaaagatgagaagaagcacagaagtcaacccaaagatctagctgccaaacggaggcccgaaga

SEQ ID NO: 376984 - DNA, 931 bp, Homo sapiens
cccagccccagccgcggccgccctggggacgcagacgccaaggcccctccggccagggccgggagccgggccggcctagccaggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaatgtgaaaagcacagaaggcgacccgaaacaacttccc

SEQ ID NO: 376985 - DNA, 310 bp, Homo sapiens
tcaattcgcgcacctactccaagttcaaaaactctctggtggtttccttcctcaggtaaacgggtagaagccccccagtgttgccagacggcccggggctgtgccgcatgtcagcagtggtcattttcgccctgcactgaggcctctgccccccggaagctcacagctcagctctcaccagggagagactttgataacattcgtgaggggcttccggcacagtgggtcgtttcttccctctgtctgtggaggtgactcctgcagtctctcctgccccctacagctactgcgactactaccggccccggtt

SEQ ID NO: 376986 - DNA, 438 bp, Homo sapiens
ctcccgcagtcctggacttggtctggaatggtgtcaagccactgcccacccaccactgccttcccccttgctgcctctccccgcatgttttcccaggatgccaagaccagccctttcaccatcccctggcaccactccccttcccccaccctaaaggctcagcttagattcccacgctctcctacacctgcgctgcctcaggtccctgccgtggcctcgagccaagtgcgatatccctgactgtctctttcccgatgggcgtgagccccagggggcttcctggtcaccatggtgttcccagctcccagcccaccatggatgctcggatgctgctcacatgaggtgacagctgggccccccacactctttcaggacatgagtgcattggtggctgcccgcatgcggcacatccccttggccccagggtcagactggcgc

SEQ ID NO: 376987 - DNA, 394 bp, Homo sapiens
aggaagctgcggtatacccaccatgacaggaagaacggccgcagcagctctggggccctccgtggggtctgctcctgcgtggaaggtgggtcctgtaagttgtggttcccggtgggctgaggggaaggaaggcagagccctgggcctttggcctgtgaacctggaggccagggcagggcacagacacaccaagcctgggtgtcccagagaaggtagctgctgaccatgttgagtagtaaaagcaggctgggttcatggcccacacctataatcccagcactttgggaaaccaaggcgggaggatcacttgagcctgggaggttgaggaggctacagtgagctgtgattgtgccattgcactccagcctgggagacagagtgagaccctgtctct

SEQ ID NO: 376988 - DNA, 496 bp, Homo sapiens
ctctgtccttgtgaccacagccatcagggaagcgacagggctcctggtctccagtgttctccccgagtgctaagaccttggggcccttgcagtgctttcagagctggccggacttccccgcagggtttgctcccaccttccccagtggctgtcccctgggctcagctgcttttgttctttatctgctccaaactcctctgaccaggagcacgcctgctgaggtaactggggatttctgcaagtgcactccgcattggccagccactcccgactcaggctgctgaccctgggcctgggtctggccagtccagttgggagtgtcccactgacggtggggttgtccgtccttctcccccacaggccggtcagtacggcgtggcccagactaggaggcgggccatcatcctggccgcggcccctggagagaagctccctctgttcccggagccactgcacgtgtttgctccccgggcctgccagctgagcgtggtggtgg

SEQ ID NO: 376989 - DNA, 473 bp, Homo sapiens
tggggcttggcctttccgtgttgttaccttaaaacgatacatccacgttctcccaggcatggatgaggtagcccaattggacagcagattctgcatagcactttttcctgttctagaaggtactctcaagtgcttgtaataggcatttcagtgtcagccagatcaaatgttagtattaataaaatggattgttttaagtttctattgtagcaaagtcaaactactcttattggtggctaattggtcatggccccactgagggagaaattaagtgactatcaaattgccttcttactagtctgcgttagagaggggacagtgcgtttctctcccaaacgattgcagttctctccttttcaggccgcctataatgcaaagagcaaaagctttgaagatcctcccaaccatgcccgtagccctggaaacaaagggaagggcaagggaaaaggtacgtcattgtatgagtttctttt

SEQ ID NO: 376990 - DNA, 523 bp, Homo sapiens
gcctcagcctcctgagtagctgggattacaagtgcccgccacaacccctggctaatgtttgtatttttggtagagacagggttttaccacgttggccaggctggtctgaaactcctgaactcaggtgatcctcatgccttggactcccaaagtgctgggattataggcgtgagccactgcacctggtctgaggctgactttatggatggtgctgtgtccctccatcagaaaggtgtgtgaggtctcttctctgacactagcagctgttgatcggtgtttagacccgtgatttcttaggacttacaagatggcaagacaacattctaaacccgtcattcagagaaacattaaacttgaagcctctttcaacatcctggtgaatgagggtccacttcaggccagctggaggcctagggtcttgttccactaatggttggcctcactgtgtgtgacagccctgccaaacggaaacctcaggaagagtctgaaagagccaaatcggatgagtccatcaaggaagaag

SEQ ID NO: 376991 - DNA, 418 bp, Homo sapiens
gtttgtgtccaaaacttctttagaactgtgatattcttacaggcaaatgaagttgcttaacaagtgtttgtattttctcccctatttcttcctcccaggctcaaagatttggaaagagacagcttaacagaaaaggtaatctccaccttaaaatttttcttattaccaaatctgactgacacactttgtggctcataaaaagaaatttgttttctttaaatggattttgcattttttcccatggagtttcaaagataatttggatattcttgttaaatgtcagcactaatttgctgctaatagttgggtggtggtggtgtttttttttgttgttgtttttgttttttgagacagagtctcactctgtcacccaggctagagtgcaatggcatgatctcggctcactgtgacctctgcc

SEQ ID NO: 376992 - DNA, 5409 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376993 - DNA, 5605 bp, Homo sapiens
agactctagaggttccccagttcgacggagactctcaagcagacgcggtggatgagccacagatgctgacaaatgagaagctgtccatctttgatgccaacgagtctggcttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagacccgagtatgcgcccatatttgggctgatgcaggagaagatctacatcagcaagattgtggtggagttcctggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376994 - DNA, 5313 bp, Homo sapiens
gttctgacaggtttatgggcctaaggttcactctggtgagactgtcttctgtcattccctttctgttcctaccctagtccagcttccttcaagtgctatccctttggtctcccatggcctggacaactggccatccctggggccactgttttgccctcaggttctggatgaaagacagctggattcatggtccgtactgctgagtgagtctatgatcttgggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376995 - DNA, 5337 bp, Homo sapiens
tagctggggttacaggcacgcagcaccgcggcactgcaccggctattgttcttttatttttttccctctttgtccctgaaagagtcaagctactaattgtcagtaatcaaatcagaccacgatttcccaggcaaactcctggcagttctacatttaggaatgactagctagagacatcctgaagaatgagttattcggggaggcgccagccacctcctctaacttcacctctatctgccctctgtgctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376996 - DNA, 5223 bp, Homo sapiens
cccagccccagccgcggccgccctggggacgcagacgccaaggcccctccggccagggccgggagccgggccggcctagccaggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376997 - DNA, 6250 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggtggtgcccctgcttgctagagggaaggcttcggggtcaaagttggccagaaggagtctgatgtcgggttatacacaaggcggcttggctgcagggtttcagcttttgtaagaagtgggtggttggctgacgtgaagctgttctgcaggagctttacgggggtctgagcagggttctccagagcacaagttgtatgagattcaagtggtcccggagtttaacactcctggtttttaaaaagtacgtcattagagaacctaacgttttagtgtcttggtgcaactgaacgttgaggaccatgaggcagcttccaccagcctgactggtgtcttagtatgagttggagaaggtgcccctgctcctgggtcccttgggccaggcgcctacgtccaggcccagcccacatgcctgtgcgggtggccctcgttatggagagggcccacgagtcagctgatcaagctcatgacttgtaaattgttggggcttggcctttccgtgttgttaccttaaaacgatacatccacgttctcccaggcatggatgaggtagcccaattggacagcagattctgcatagcactttttcctgttctagaaggtactctcaagtgcttgtaataggcatttcagtgtcagccagatcaaatgttagtattaataaaatggattgttttaagtttctattgtagcaaagtcaaactactcttattggtggctaattggtcatggccccactgagggagaaattaagtgactatcaaattgccttcttactagtctgcgttagagaggggacagtgcgtttctctcccaaacgattgcagttctctccttttcaggccgcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376998 - DNA, 5547 bp, Homo sapiens
ggagaggcagcctgtcctctgaacctggggaggagcttgtgtcagcccttaggagctgttggccccggtgcagggccccccgagctgaccagcctgtgtcatatatatatatagtatattttgcagagatggggtctcagcatgttgcccaggctggcctcgaactcctggcatcaagcaatcctcctgccttagcttcccaaagtgctgggtttacaggcacatgccactgcacacagcctgtaaataaagttttattggaacagagccacactttctcatttacattttgcctgtgggtgcttttgtgctaccatagcagagatgatcatcctgacacagaccacgtggtcagcaaagctgaaaatactgatcctctggctcttacaaaaacagtttgccaagccctggtctaggaggttctttagtgccctcttgttagtttcaggtggggaattaagtgagggaaagtgaagcctcgtgtctacccggtagatctgcccaggcctgcctgtcttccagctccacagtgctgggatccctaacctgtaacttcagtgtttgcattttatctcactctggctcagaaactaattttttcccttctttatctctctacctcccccttatttttctgtcaggatgagaagaagcacagaagtcaacccaaagatctgtaagtgtttaaaatgcttgtgcttttgtgtcatctggatcagtagaaagcctgttctaggccaggtgtggtggcttgcacctgtaatcccagcactttgggaggctgaggtgggtgaatcacctgaggtcaggagttcgagaccagcctagcctggccaacatggtggaaccctgtctgtactaaaaatacaaaaattagctgggtgtggtggcgggtgcctataatcccagctactcggaaggctgaggcagaactgctagaagccaggaggtggaggttgcagtgagccaagattgcgccactgcactccagcctggacaagagtgaaactctgtctcaaaaaaaaaaaaaaaaaaaagcctgttctagaaacctgtggtgatgtagatgtgtggggaccctggggcctctgaaggcctcgtctcgggatgacaagctggcagtgtgcctatagagctcccatgggtatcttgctttcccatggggaggcattagtttgtcactttccgtgcgagttggcgatgtggttagtgtttctaagctgctacttgctgtgtatctgttcaccctgcagagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 376999 - DNA, 5752 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccaccctgggtgggtattcgtgatttgcacgggacttctggctgaggtcagacaggaacaagctcttccatgctgaaggcgacccacgtggagtttgaagctagcacgtttgaagctagacactccgtgtgtctgtctgtgtttgttcagaactgagtcacgtgagttgatccccatgacatgcaaatggaacttgctagtgtagcttccaggaaagccttttaaaggaagtcttggctggccttccccgtggctggtaggccttctttggtctgaagtgggttgtgatgcctggcagtggagcagccatcctgtgaccatgaggcagagctctgtgctgcaactg

SEQ ID NO: 377000 - DNA, 5504 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttatgcttttgaatctccctgttgggtggactaaacttatgcgttaaatgggatatttttcaataatttctgtaacaaaaaaaaaagggggggtaaaatccgggcagagtaccgtttgaagggcaagggagaaaaaaagggcgaaaggggaagctggtgggacttggggaggcccaagtcgaaagatggtggtgggaacac

SEQ ID NO: 377001 - DNA, 5036 bp, Homo sapiens
  misc_feature (4856)..(4856): n is a, c, g, or t
  misc_feature (4899)..(4899): n is a, c, g, or t
  misc_feature (4903)..(4903): n is a, c, g, or t
  misc_feature (4963)..(4964): n is a, c, g, or t
  misc_feature (5026)..(5026): n is a, c, g, or t
  misc_feature (5029)..(5029): n is a, c, g, or t
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccggtgctncaacccagaggcagaccgttttgtgaagcgttcgggagttttnccgnttccaggggtttcctgacaactaacgggtttttgggaaaaattcttgggcaaagaaccgnnaagttggggcaaattgccgttttcaaccggtctcttgggccaaaaggcattttggtttttgnggntttaaag

SEQ ID NO: 377002 - DNA, 1497 bp, Homo sapiens
  misc_feature (20)..(20): n is a, c, g, or t
  misc_feature (56)..(56): n is a, c, g, or t
cgggtcggacccaaacctanggctaggtacgaggcctgggtggttgcaaggttcanaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 377003 - DNA, 996 bp, Homo sapiens
  misc_feature (141)..(141): n is a, c, g, or t
taggagagattaatttgaagaaatattacaacaatataaaaactacataaagtcttaatttccactcatacagtggtagatttgatataaatgcaataataaaaaacttttaaaatccagaaatgcacaaagtactgcacnatttgatcactaaatcattagttgataagcgaacctcacacaacagcttcatgtcagccaaggccacaaacaccatgtacccccacgcgtccgcccacgcgtccggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 377004 - DNA, 3163 bp, Homo sapiens
  misc_feature (3086)..(3086): n is a, c, g, or t
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccacatcactcgagacgtaaattatggctgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcataggctatgtcctcccatgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcaacactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagactcctagcgaccagacaattataccctagagcaacccttaaaacccctcccaatcaaggccgaatgatattctattcggctacacatttctcgatccgtcctaacaactagaaggggtcctggcctattatattcatctcatctagaaatccatctccaatatccaaaaaaggtatatttgggcctaagcatatttttggctagcggaacctatttactgagngggggcggaggcccttccatgggaggccggaattaaaattttaattcttgagaacaggggaaaaaaaaaaggggccg

SEQ ID NO: 377005 - DNA, 1475 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagtaaaggcgggttatttgtttctgaactccccctcattcttctgctcctgtttgcttgggcgggagtgcgcagggtggggctctgggttcaagtccagccccatccacccaggctccatggggccatccagactctgggaaggtcaccttttcctccttttgggggccgggatttgtggctggatgcctgtgctggatgcctagtgaacactcagttgtcctctgtctttcacactagagagggtctgtgtgagcctgggctgagatgtgcatgaagcatcctctcctgaggcctcactgctgagaagccttgacacacagtcagctctgacgcacatgtcagccacacctttgattctttcccagcctcctacgttctgagtctagctctcccc

SEQ ID NO: 377006 - DNA, 667 bp, Homo sapiens
cccagccccagccgcggccgccctggggacgcagacgccaaggcccctccggccagggccgggagccgggccggcctagccaggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagaacgtagagttacatccagagaacgagtgctgttccgctgggtaccggctcgatt

SEQ ID NO: 377007 - DNA, 169 bp, Homo sapiens
  misc_feature (12)..(12): n is a, c, g, or t
ggcaaagtctantccgtcctccaggctgaagtgcggtggcacaatctcggctcactgcagcctccacctcgcaggagaatcgcttgaacccggttcaagcggttgcagtgagccgagacggtgccattacattccagccttggtgatgagagggaaaatccatctcaag

SEQ ID NO: 377008 - DNA, 2377 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377009 - DNA, 2201 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttcca

SEQ ID NO: 377010 - DNA, 2415 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377011 - DNA, 2394 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377012 - DNA, 2453 bp, Homo sapiens
  misc_feature (2015)..(2015): n is a, c, g, or t
  misc_feature (2033)..(2033): n is a, c, g, or t
  misc_feature (2046)..(2046): n is a, c, g, or t
  misc_feature (2056)..(2056): n is a, c, g, or t
  misc_feature (2072)..(2074): n is a, c, g, or t
  misc_feature (2081)..(2081): n is a, c, g, or t
  misc_feature (2092)..(2092): n is a, c, g, or t
  misc_feature (2112)..(2112): n is a, c, g, or t
  misc_feature (2125)..(2127): n is a, c, g, or t
  misc_feature (2135)..(2138): n is a, c, g, or t
  misc_feature (2142)..(2142): n is a, c, g, or t
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatgcgaaaanaaaaaaaaaaaaaaaaanaaaaaaaacaaanaaaaaaaaanaaacaggtaaaaaaannncaaaccnccccccccccncccccccaatgccccccccnccccccccccccnnnacaacccnnnnaagnaggctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377013 - DNA, 1420 bp, Homo sapiens
actctgagatccctgcatgatgtcctgccatatggtgacatctaggagttttatattgggtagcaacctgcttttccagaacctcatgacccttcaactaattctgcagccactatcagccaaaaagagcactctgagttccttttggaagttaaagcccattgtcctagaaacctcagtatggagattcaaggtctgaggaactataagccatatgtaggattaccttattaaaccctagaactcaaaagtatcactggattaagcccttttctaccattttaatctcactttttccagtatacaaaggactgcctcaagccatagtacccctacaagtggttggagactagaatcccatctgtgctctgcaggtggaaagcccaggcttgcagaagtcagaagtaaccagaactgtttagagccaggtccaggaacttcctatggccttttggtagcaactgtgcatggcagccctgttggcgttttctccacaggctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377014 - DNA, 1967 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggttttgaatgatgtttactttgttggctgaaaagactgtgttgggaaggaatgctggggcttggctcagtgaggggttagaggcaaaacagtgcagagtacacgatccttcccagagaaacatctctggtttcctgagagtcaggatccaaaataaggaatttctttcggtaaaagaccaaatcaaggcctggtgaatataaactaagggagcactcaaaggaatagcctccatatttctgctacagggctgcgggcacagaacagtttaagataccctccctttccccaaggggtttaaataagactggctgg

SEQ ID NO: 377015 - DNA, 919 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggccgccagcatttgcttccggatggtctacagaacttggagagttggaatttatccatccctcccgatttgtttgaaatcagccttctggaaatctgcagttggaaaaaggaagcattgagtttacttaggaaaagttaacagttcctgtgacttaactgcacttaaaccaaaagaaaagcaaatgtgtgttcgaaaat

SEQ ID NO: 377016 - DNA, 546 bp, Homo sapiens
tgtgaagtacctattcaagtcttttgcccattttttttcactgagttgtgtttttcttatagatgtataggaattctttatatattctggatatgagtcttttgtcagctgtatgtattacaaagatcttgtctctctttgtggtttgcttgtgtgttgtgagctttggatttttactgccaggttagtggaactgtacaattgctacctgaaaaatgggggatctgaactgcttttgatcagtggtgggggtggttcccccactggtgagggtgaatttgatactggtaaggtggaccttattgggtctctgtcaagagtctgccacctctcaaagaatttgaggactgaccttgttctttttttgctttcaggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaa

SEQ ID NO: 377017 - DNA, 389 bp, Homo sapiens
ctattaagtgtcaatgaatgggacgaagagagccctactactactactacacgtttcgatcactccccaaggccgccagcatttgcttccggatggtctacagaacttggagagttggaatttatccatccctcccgatttgtttgaaatcagccttctggaaatctgcagttggaaaaaggtggttcgccgtacaaaacctgtcctttggggaataggttgtcctcacttttccgtgtattctcccctttttctttttcctcttctttctcctaggaagcattgagtttacttaggaaaagttaacagttcctgtgacttaactgcacttaaaccaaaagaaaagcaaatgtgtgttcgaaaattacacaaataaaataagttttcta

SEQ ID NO: 377018 - DNA, 2455 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377019 - DNA, 2238 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcgggccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377020 - DNA, 2519 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagtcctctccatgatctgtgtcaaactgctttgggcctttatgaagtggcctgtgctgtactgtagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377021 - DNA, 2256 bp, Homo sapiens
gcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctaggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377022 - DNA, 770 bp, Homo sapiens
cctcctgcattacttcattcagtttctcatcttcattctctccagcctgggggagaatacactgagcaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatca

SEQ ID NO: 377023 - DNA, 1751 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377024 - DNA, 1721 bp, Homo sapiens
ttcggtgcctctcgccccgtttgtccccccccgccggctggtccggtccggcctgctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377025 - DNA, 1783 bp, Homo sapiens
  misc_feature (1762)..(1762): n is a, c, g, or t
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctaaaaaacacaanaacatcagcaccgaccaaaca

SEQ ID NO: 377026 - DNA, 1818 bp, Homo sapiens
ttcggtgcctctcgccccgtttgtccccccccgccggctggtccggtccggcctgctcctcgggactcggcgggtcctcctgggagtctcggaggggaccggctgtgcaggtttgggccttgacgtggctgtggatgcagtcgttctgacccctggtggccgagaggtgaagtgcagtggcggctgcttgctcaaggccggaggaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377027 - DNA, 1723 bp, Homo sapiens
agcacttgttttaaaaggcagctttaaaagcccttgatggttgtttgtttgctctgaggctctgaaccagagaagcccagctcctgttacagattcatcaaatgccggaaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377028 - DNA, 1894 bp, Homo sapiens
ttcggtgcctctcgccccgtttgtccccccccgccggctggtccggtccggcctgctcctcgggactcggcgggtcctcctgggagtctcggaggggaccggctgtgcagagaacttcagccaaagcatctgagacgggaagcagaaaaaggagggacagtttggagaagaaaaacgcagctgtgtgtttgggccttgacgtggctgtggatgcagtcgttctgacccctggtggccgagaggtgaagtgcagtggcggctgcttgctcaaggccggaggaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377029 - DNA, 1676 bp, Homo sapiens
gacacgttgtaaagaggcagtactatacggtctagggtagcatgctggtgggaacggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377030 - DNA, 1602 bp, Homo sapiens
ggcatctctgtttaatgggccctgctcctctggaattcctttgtggagactgagcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377031 - DNA, 1671 bp, Homo sapiens
ttcggtgcctctcgccccgtttgtccccccccgccggctggtccggtccggcctgctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377032 - DNA, 2002 bp, Homo sapiens
cttctgcctttttttccccccatacaagtaaggcattattgaaaggtatataagtttatctcacattgtaaggtaaaagaggtttctggatgatgaagtgcccgatgcaccagctttgactgtgcgtaacaatatcgtgtgcctgtgtagcatttaaattctttcctaagtgcttttgcatcctcatagcggcccgtgatgggcagagcagggctcattactcccgtcttctggatggggctctcgaaggcaagtgatcacctaagtgcgaatggacgaagattccgatctaggaggcaggtgcccttcctggtagcttggtgttctgtctatttcatcacagactgagaatctgggaaggctcagaggaggcagcctggaaatgaaatgtcttttcattttttttttcccaaactagttctttctcagaaaccttttatcctaaggctcaggactgtgagcaaccactggggaggtcctgggtttaacaatttcctttccatgtctgccaggctccagcccacctgggagaggcttcttctgaggttcacccctcccctgtgtctttgtctcctttctctgcgtctcagacgaggctgtcataccgggaatttcagtgggcaggtgctcaaggaagggagagaagcagataaggataccagaggcagctgaagtgtttttaatttaaattatcctcctcctcagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377033 - DNA, 985 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacacccttctgggcacggagtttggccttgcacattttatgggtccttttccttaaaacttgtttcttcccgg

SEQ ID NO: 377034 - DNA, 1033 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377035 - DNA, 427 bp, Homo sapiens
taggaaacaaaggatattttattccttttttctgttgttgttgaggatagatcacgatacagagaacagcaatgggtcccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377036 - DNA, 685 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377037 - DNA, 541 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagggtcaaagtgatacaatggacatcgaagcaccgtgacaattctccatgtagccattatgctataaatgttggcatcactatccaaaa

SEQ ID NO: 377038 - DNA, 443 bp, Homo sapiens
caggtgatgctgtgatcgcatgtcctgaaggacctggatggcagggactggagggggtgggcccccctgcactatccagaagaacggtttcctacctctgagctgggcttggaggcagtctggtagagcctgaggctcagaacatccccgaggtcccttctgctctaacagtgtgagcttggaaagaccccagcctctctgtcagtttccttttctgaataatcaagtccttcctagctttggggtaagctgggcctcctgctcactgtgtaaccctggaaaagccacttaagcctcagtttcatcacctataaaataaatgcatcaagatgttttctgttatctcacagggtcaaagtgatacaatggacatcgaagcaccgtgacaattctccatgtagccattatgctataaatgttggcatcactatccaaaaccttgt

SEQ ID NO: 377039 - DNA, 1887 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctaaaaaaaaaaagaaaaaaccgagggcctttttcgggtggcggaacgcggtctgactggcctggtcctagcgttccggacccattttttacaggtggaccctccgcccccaagggggcattatccaaaccggtatcaa

SEQ ID NO: 377040 - DNA, 1885 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcacaaacgaaaggattaatatcctgttctaaaaaaaaaagggggcgctaaattcctcaaggccattaccgtccccttttgtcaaggcctaaaggggataaacagcagcccgttaaaggagaaacgccgcttgggacccctggtgcatgacccaagaaccaaaattggtactcggaga

SEQ ID NO: 377041 - DNA, 1696 bp, Homo sapiens
ttcctgcccatttccacatgtgccagggaggcagcaagaaagagtggaaggtgcatggcaccagcagaattagtgacagttccagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377042 - DNA, 1816 bp, Homo sapiens
ttcggtgcctctcgccccgtttgtccccccccgccggctggtccggtccggcctgctcctcgggactcggcgggtcctcctgggagtctcggaggggaccggctgtgcaggctaatcagcattgagtccagcaaggttgggaagccaaacctgagactacctgcatgaagccaagaacccttgagaggggctaaagtgatctcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377043 - DNA, 1663 bp, Homo sapiens
acaggctaggtacgaggcgggtggctaatcggccgagggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377044 - DNA, 1936 bp, Homo sapiens
agagtcatgatatgaccctgatgccgttatctattgcctgtagcgttacatccttgcgttcctgtctagccttgtttctactgttgctaccgtgctttggcctcctcgtcgcagctcttgcctgtctgagctggtctcccgtcccccgtcttctggattgagtccctcggctgcatctgatcccgctgtctgctattgaagtcagataccgcatgtatgacgtctgtaccgctacctgacggctttgctattctgatctcttgtccttctactaggactctccaatctgggaaggctcagaggaggcagcctggaaatgaaatgtcttttcattttttttttcccaaactagttctttctcagaaaccttttatcctaaggctcaggactgtgagcaaccactggggaggtcctgggtttaacaatttcctttccatgtctgccaggctccagcccacctgggagaggcttcttctgaggttcacccctcccctgtgtctttgtctcctttctctgcgtctcagacgaggctgtcataccgggaatttcagtgggcaggtgctcaaggaagggagagaagcagataaggataccagaggcagctgaagtgtttttaatttaaattatcctcctcctcagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377045 - DNA, 954 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 377046 - DNA, 1168 bp, Homo sapiens
cagcccgactcctaggagcgaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaaggtgagatgctcagtgcctggattggcccctgttgccatcaccgtctgcatcagggcctggacaggggttcaggcgggaaggatggggctagcttttgcagtgggcacagcttttattatgggccctgccctgaggagccttcaggagtctgaaaggggctgtgagagagaccaggactagaaacacccgaagtgtcccacacacatgcatgccaacaccaggaaatggggcttccacacagcccactggccgagtgcatagggcgtcatcccaagtgcaacatgggagaattagagttagtgaaatgctcctaatctcaaaatagcataaagataatggctttccgtggtgactcagaaagtactttagggccacttgtttttttaaacaccttattatgaaacttcccaaccctaaccaaaagtagagcaaatagtatatgatccttccctctccacatttaagggcactgattttagtatctatttccattgttcatcgtagggggcacaggagagtagtaactggcaaatgctgtacagttttcagagtgccaccacacacacagactcactcgagtctgccagaaaaagaggatgggacaggtggggtttagcccattttataggtgaaaccaagatgagagggaatagccccgtggagagtgacagcccggactgtgaactcaggcctttgcggctgtggttcagcgcc

SEQ ID NO: 377047 - DNA, 642 bp, Homo sapiens
ttcggtgcctctcgccccgtttgtccccccccgccggctggtccggtccggcctgctcctcgggactcggcgggtcctcctgggagtctcggaggggaccggctgtgcaggtttgggccttgacgtggctgtggatgcagtcgttctgacccctggtggccgagaggtgaagtgcagtggcggctgcttgctcaaggccggaggaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatggtaactgtccgtgaccacctgcccaggtggaaaagagggaacagagagacccctctgtggctcaggaagggactgttgccaggtgcatggccagccagacatgctcccgcagtgccaggagagtgggtctccagggcctctgcagcattgccccctcactccaccaaacag

SEQ ID NO: 377048 - DNA, 412 bp, Homo sapiens
acaaaattagccaggtgtggtgtcatgtgcctgtaatcccagcttctcaggaggctgaggcaggagaatcgcttgaacctgggaggcagaggttgcagtgagccgagattgccccattgcactccagcctgggcaacaagagtgaaactctgtctcaaaaaaaaaaaaaaaaaaattcgtcttccagaacaatctaaagatggagcaggatgcggttttctcctccactctggagacatatgatgtatgcactagactgcaccacagtccccttctctcaccaacgcctttgaatgaggcccaggttcctcagtcctggttctcgatggtgacatagcccaggaacacggtggaaaggatggtgctgagcagctcagtgatgcttccctggggcctgggtccgactacagct

SEQ ID NO: 377049 - DNA, 797 bp, Homo sapiens
tttgagaggcattgaggtaggagactctatgacatgccctcagaatatcagaatcttcttagaaataaactaggaaatgcagatgtttttaactactcagacttttgaggaattaatccttttaaaacatttttgttaaagttagtgtatcagtaagaaacagacctagtttaaaaggaataatcaacaattttataaaggagatggcttattcaaccatagcccctccaacatatctactggaaattctgctggttaactttatctctctctctcttaatttagactttcaacctatgaaaatgtaaatacctttgaaaaaactaaactatcagtcatttacatcttctcatgaatgaaatgcagtgtagggagaggagatggcaggacacagcaaacaggacacatttgcctgcttctctcttgcctaattcttcctgacctgtatttactgatgcttaataatacttgtaagactctaggggttcatttcccatttcagcggaaagtacttcactcaacaacaatattctcaagagtcttctactggaagctagaaagaaataggaatttaagtccatagaatgaaggtagttattcctgcctgtgttgcccacctgttcacaaaaagtacctttatgcttgaaaacattaggttctttggttactgcactgtagtttcaaatggatcctccagatggcattcatgtcttactcagaaagggcactgccattgtccccaaggcttctgtctactaattctattggtcttgtgttttgcttgattggcaaaaaaa

SEQ ID NO: 377050 - DNA, 2418 bp, Homo sapiens
cttccaaattagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttagcccccaaggttggggcccgacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcacc

SEQ ID NO: 377051 - DNA, 2364 bp, Homo sapiens
cttccaaattagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttagcccccaaggttggggcccgacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggacccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcacc

SEQ ID NO: 377052 - DNA, 335 bp, Homo sapiens
gaagatgacactgcttcatttcatcgccttgacagtgaaggagaaatacccagacctggctaacttctggcatgagctgcactttgttgagaaggctgcagcaggtgaggagagcctggctgggtgggcctgccctcacatccagcccaggacaatcccaggaagctatgaggagagagaacacttgggtccatttgtttctggcttttgttatcttctttctgaccacttcaaagctttccgctggagccttaagcaggggccactccagagggagccttcctccaggcgccaggcctggcccagcccagcccttcccagctaggtacagtggg

SEQ ID NO: 377053 - DNA, 503 bp, Homo sapiens
gactgaaaaatgcaatagagagtatcaacagcagaattaatcaagcagaagaaagaatctgtaaacttgaagacattatttaaaattacagttggaggagaaaaagaatgaaaaggaatgaagaaagctcatgggatttatgagacagcatcaaaagaacaaacatttgaataataggagttaaggcagaggaagagagataaagtggtagaaagctgttttaaagaaatattagcagaaaactttccaaatctggggaaagatataatatccaggtacaggaaggtcaaagtctctaattagattcaatccaaacaagactacactaagccttattataattaaactgtcaaaaaacaaagacaaagagaagaccctgacagcagcaagagaaaagaagcaaataacatataagacaatttcaataagcctagtagtacatttctcagcagaaactttataggccaggagagagtaggatgatatgttcaaaatgttgatgg

SEQ ID NO: 377054 - DNA, 476 bp, Homo sapiens
ggtaggaaggcagaaatgtgatagctaagatagagtaaaatatcagaagctgtattgaatttaaccttctgtatggggtaaaaagataatgtgttaagtgaattaataaagtaaaagatgttgtgagtaatatttaacacatgaataattgagaagggataattatactatttcccagaaattatagaacattgaaatttatagaataaatcaagaattggccgggcgcaggggctcatgcctgtaatcctaacactttgggaggccgaggcaggtgaatcacgtgaggtcaggagttcgagaccagcctggccaacatggcaaaacccatctctactaagaatacaaaaattacccaggcgtggtgctgggcacctgtaatcccagctactcaggaggctgaggcaggagaatcacttgaacccaggggacggaggttgcagtgagctgagattgtgccacttcactccaacctg

SEQ ID NO: 377055 - DNA, 501 bp, Homo sapiens
tgcagtgagtcaagattgcaccattgcactccagcctgggagacacagtgagaccctgtcccaaaaataataatagacgggtatggtggctcacgcctgtaatcccagcactttgggaggctgaggcgggtggactgcctgaggtcaggagttcgagaccagccaggccaacatatagtgaaaccccgtctctactaaaaatacaaaaattacctgggcgtggtggcgcacatctgtagtcccagctacttgggaaactgaggcaggagaattgcttgaacccgggaggcaaaggttgcagtgagctgagatcacaccattgcactccagcctgggcaacagagcgagactccatctcaaaaaataataataataataatatagattgtatcattccatataaagtccaaaaagcaggcaaagctaatctatgacattagatcagctaaaggtcacctttggggaagaagagacagaaatagagggcacaggagccccctg

SEQ ID NO: 377056 - DNA, 367 bp, Homo sapiens
ttaatggttttaacttcacagtctcacaggatattcttgtgaaaactgtcaaatagtacatacctgttttaaaaaggtttataagtctgtgaattgatagaaaaatataaagcagagtttctcttgggaggccaaggcgggcggattacgaggtcaggagatcgagaccatcctggataacacggtgaaaccccatctctactaaaaatacaaaaaaatagcagtgcatggtggcaggcgcctgtagtcccagctacttggaaggctgaggcaggagaatgctgtgaacccaggaggcagagtttgcagtgagccgagattgcaccactgcactccagcctgggcaacagagcgagactccatctca

SEQ ID NO: 377057 - DNA, 314 bp, Homo sapiens
gaatgcacaagctatagtctgctgtattcatggagcacacaagaaagaaatgtgaagaggaaagaagccctgtattacttagatttgactgcttcatgccagtctcaggagcttttccagaaatgggtctcactatgttgcccagattagtcttgaacttctggcctcaaaggatcctcccctctcagcctcccaagtagctgggactacaggcttcagccactgcaactgtcagttccgactttccctgcctcagccttgttccctcttacctcacaaagaaaagacggctgccagcaactctagaaaaaagt

SEQ ID NO: 377058 - DNA, 293 bp, Homo sapiens
ggagactctgtctcaaaaaacaacaccgacaacaaaaagatgagctaaaagagctctgcagatgcagactttaggggaactaatgggggtatctgacaataacccaatcaatccttttcattctgagggtgtggggcccttgccagggtgaccgtgggcatatctggaggccccggggcccatgcaggagaccaagctaaggcttccttagtgagcttgcccggctctgctccttggctgcaaaagtctaaatgtctttcagtgaattaacagttcatttggggatgaagaaa

SEQ ID NO: 377059 - DNA, 736 bp, Homo sapiens
tcacagcagctcatgaagaaattccacatgaacagggctgttaaaagccaacccgccagaaagggtagaacggaggaaggacaagagggttctaacacctcctggaggcagagcacccacggaagtttctcaacacttctcgttgattcaagtggaacaccttgaagagaggcccttctgtttccctacacggtggacagcagagctctgaaaattagatgcttccccaaacccagactctcttggaacattcttcccatgcgggtggtatgaactgcgtggcactgctgtcctcgctggcatatatagatttacactccacgcacgagacttccaaggcaacacctaggatttagagactatgttctcagagacgggcatggaggcaacgtcctggttctcatgtggtcaagaaggtagatggagagaaacgtgtgctaagcagcccggccctccccagagaagccacgggcagaggctcaccaacacctgcccctccctccatggtgtcgccggctttcagaataaagccttttctagcatgtctcgttttggggatgtttcctccatgatataccaagcactggaaattcaaatgtcaaaagcgagtcaagacaggaacactaaatgatgtctctctcttgacggttgtctgccagaggtgcttcccttcgaggtacctgaaatcctagaaattgaagttactttgtgactcatgcctactttctcctcactg

SEQ ID NO: 377060 - DNA, 861 bp, Homo sapiens
tgggcgtggtggtgggcgcctgtagtcccagctactggggagggtgaggcagaagaatggcctgaacccgggaggcggagctttcaatgagctgagatcgcgccactgcactccagcctgggcaacagagggagactctgtctcaaaaaacaacaccgacaacaaaaagatgagctaaaagagctctgcagatgcagactttaggggaactaatgggggtatctgacaataacccaatcaatccttttcattctgagggtgtggggcccttgccagggtgaccgtgggcatatctggaggccccggggcccatgcaggagaccaagctaaggcttccttagtgagcttgcccggctctgctccttggctgcaaaagtctaaatgtctttcagtgaattaacagttcatttggggatgaagaaaattgaacctcagcgcccccaaaattttgagggctttgtgaaaatgggaattcatgggagtctgctggtggccaggcctgaaggggaggacagcagtctgcgcaggccgcggggcgagggtgggccgctccatcctgacaccctcggttctttccacagagcacccacggaagtttctcaacacttctcgttgattcaagtggaagtgagtaaattccctgacatccctaccgcttctctgcctctagggtagtaaaaacaaaaacacagctcgtaagacagggtggagaaggcagagaggcttctttctgatttaagctaactctacggttgtgacatgtaacaaaacaaaacacagaaacacagcaccaataaatcaagaaacacagggagatgatcccatggaagtccaagtgagaccttctgtctgaaatcaggg

SEQ ID NO: 377061 - DNA, 378 bp, Homo sapiens
cctccacatgggcggaatgagcagtgactgagcacagcctggtttgggtccagccttggtaatccagcagcctgagatgtttctggaacagggaatgcattgtggataggaggtgaggaagtcccagctaatatcattttggtgagggagaagaggagacaaggccagaaatgtcaacagttgcttggcttcagctgtcctaagtgactggtcctctgggccctagacatgagggcaaatgagaaatgggtccctccaacatgcattccttacttccctttgtcacagcctggacattcaaacagaaacacacccagcatgcctggcactgcccaccatgctgttatccgtccccatctcctttctcctgacctctct

SEQ ID NO: 377062 - DNA, 454 bp, Homo sapiens
ctgccatgtgaggacacacgctcctcccctccagaggatgcagcaacaaggcatcatcttggaagcagagagcagccctcaccagacaagtgaaccggccattgccttgatcttagatttctcagcctacagatccatgaggaaatacatttctattatttgtaaactacccagtttcatgtattctgttatcacagcacaaataaacacagaaactatcatgctgttttcaaaagtttttgttttttagattattacaaagtaaaattcacctttttgtggtatatagctttatgggttttgatacatgtgcagataagtgtaactgctaccacagtgaggatacaggacaattttatcacccaaaaaacttccttgttctgttcctttatagtcacagtctctctcacctctaacccctggcaaccaccaatctgtcttcatcaaaatagtt

SEQ ID NO: 377063 - DNA, 2034 bp, Homo sapiens
tgccccgaatgcactggagtggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaacccgatgtctttttttttactgtggaaataggatcggaagagagtaacattttttttttaatcctgataaagaagattgttgggaagctctttgaaaaaaaattttaaattgtggcacagatggattttaaaaagtgttagatctttccaatgaacactaatagagtactctgctcttggctggatttttcagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaaaaaaaaaaaaattgaaaaaaacacaaagggggggcgggcctaaaatttcccccggggggccccatttagccgtccccgtttttttgaaccagggggccccaatggggggcggattataa

SEQ ID NO: 377064 - DNA, 2007 bp, Homo sapiens
aggagtctgcagcttttcagtgcctgggataactatagtttaaagatcattgtgtaaaataggatttttagtcagcatgcattgttttaaaccgactaactgatagcctaaaactttatttttgcattttgccaatccttggagttttgttttgcagaattaagaaaaaaatgaatgtatgatcatctgaaaagggctttctctcaatcccacttcatggcatgacctctgctggatcattagttctagccagagaagtagcaaaggaacatgacgtctgagacctcccttccctcatcagtggggctgactgagctgggggcttgaagccggaggtaacctttcctgtcgaatgttctctttagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaaaaaaaaaaaaattgaaaaaaacacaaagggggggcgggcctaaaatttcccccggggggccccatttagccgtccccgtttttttgaaccagggggccccaatggggggcggattataa

SEQ ID NO: 377065 - DNA, 1915 bp, Homo sapiens
tgccccgaatgcactggagtggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaacccgatgtctttttttttactgtggaaataggatcggaagagagtaacattttttttttaatcctgataaagaagattgttgggaagctctttgaaaaaaaattttaaattgtggcacagatggattttaaaaagtgttagatctttccaatgaacactaatagagtactctgctcttggctggatttttcagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaa

SEQ ID NO: 377066 - DNA, 1202 bp, Homo sapiens
tgccccgaatgcactggagtggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaacccgatgtctttttttttactgtggaaataggatcggaagagagtaacattttttttttaatcctgataaagaagattgttgggaagctctttgaaaaaaaattttaaattgtggcacagatggattttaaaaagtgttagatctttccaatgaacactaatagagtactctgctcttggctggatttttcagagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatatagaaaaaatccctttttatttaaattaatttaacaaaaaacttgaggggggggccccggaccccaattggcccttttagtgg

SEQ ID NO: 377067 - DNA, 1856 bp, Homo sapiens
ggacatcagaaccccaggctctccagcctttggacttcaggactgacacaagcaacctgctgggttcttaggcctttggctttgtactgagacttacaccatcagcttccctggtcctgagacttttggacttggattgagccacgctactggcatcccaggatctccagcttgcagacagcctgtcgtgggacttcacagcctccataattatagaatggcaatggtctctgcgatgtcctgggtcctgtatttgtggataagtgcttgtgcaatgctactctgccatggatcccttcagcacactttccagcagcatcacctgcacagaccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatgcctccatagtgattgggaaatggtggtgtgagatggagccttgcctagaaggagaagaatgtaagacactccctgacaattctggatggatgtgcgcaacaggcaacaaaattaagaccacgagaattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaaaaaaaaaaaaattgaaaaaaacacaaagggggggcgggcctaaaatttcccccggggggccccatttagccgtccccgtttttttgaaccagggggccccaatggggggcggattataa

SEQ ID NO: 377068 - DNA, 465 bp, Homo sapiens
cacttattgatgaatgtaagtcatttgggaaagttttggaagagtttacattttaatagcaagacaaacatgtattatgatggagcttgtgatgtatttctgcctcctggagttttattttgtttttctgcttatgttttagtcataatgccacaaagttgtggaatttttgtgattaattgctgttactagtactaagagaagcaccagaagagatgccaagaagtttttatatgaataatttctatcagtgagaattaagcatatggaaaatattcatttagttgtattttatacagtaataactcttagctgtcgtgtaagttcctttattcggtttcatagtctttataattttagtgcagaattatattaagcctccaagatgtctgatatttgttcactcacattaggttgtaaaacttagaaactaaattgcaaatatatgtgttattatatactcca

SEQ ID NO: 377069 - DNA, 912 bp, Homo sapiens
atggaaagtgccctgccgagtatcttcactcttgtaataattgcagaattcataattgggaatttgagcaatggatttatagtactgatcaactgcattgactgggtcagtaaaagagagctgtcctcagtcgataaactcctcattatcttggcaatctccagaattgggctgatctgggaaatattagtaagttggtttttagctctgcattatctagccatatttgtgtctggaacaggattaagaattatgatttttagctggatagtttctaatcacttcaatctctggcttgctacaatcttcagcatcttttatttgctcaaaatagcgagtttctctagccctgcttttctctatttgaagtggagagtaaacaaagtgattctgatgatactgctaggaaccttggtcttcttatttttaaatctgatacaaataaacatgcatataaaagactggctggaccgatatgaaagaaacacaacttggaatttcagtatgagtgactttgaaacattttcagtgtcggtcaaattcactatgactatgttcagtctaacaccatttactgtggccttcatctcttttctcctgttaattttctccctgcagaaacatctccagaaaatgcaactcaattacaaaggacacagagaccccaggaccaaggtccatacaaatgccttgaaaattgtgatctcattccttttattctatgctagtttctttctatgtgttctcatatcatggatttctgagctgtatcagaacacagtgatctacatgctttgtgagacgattggagtcttctctccttcaagccactcctttcttctgattctaggaaacgctaagttaagacaggcctttcttttggtggcagctaaggtatgggctaaacgatga

SEQ ID NO: 377070 - DNA, 453 bp, Homo sapiens
agtagccatcccaataggtgtgagatggtatctcactctaattttgattttcatttccctactgattagtgatgttgaccatcttttcatgtgccttttggccatgcgtatatcttccttggagaaatgtctatctaagtcctttgcatacttttaaattaggtcttctggtttttagctgttgaattttaggagttctctattcattttggatattaatcccttatcaaatatatgatttgtaaatcttttctcctgttttgtgtgtggccatttttttctctgctgttactgtcttttgacacacagttttttaaaaattgataaaattattttttgttgcctgtgccttttgtgttaatcaaaaaaatagttgccaaattaagtgtttcgaagcttttgttttatcgttaagggtttataattttagatcttacatttacatctttgatc

SEQ ID NO: 377071 - DNA, 256 bp, Homo sapiens
attaggttcagattcaacgtttttggttgagaaaactacccgaatgatattacggcctgtaatcccagcactctgaaaggcccaggtgggtggatcacttgagctcaggagtttgagaccagcttggcgaacatggtgaaacactgtctctactaaaaatacaaaaattagccgggcgtggtggcacgtgtatgtcattccagttaggaggttgaggcacgagaatcatttgaacccgggaggtggaggttgcagt

SEQ ID NO: 377072 - DNA, 426 bp, Homo sapiens
  misc_feature (373)..(373): n is a, c, g, or t
  misc_feature (381)..(381): n is a, c, g, or t
  misc_feature (402)..(402): n is a, c, g, or t
  misc_feature (420)..(420): n is a, c, g, or t
tcccagtgaattcgagttataatctgattccaaccccctacttccatccccaaccctggtgttttgtttcagtgttttttgttttgttttgtttttttgagacagagtctcactctgtcacccacactgaagtacagtggcacaaactcagctcactgcaacctccgcctcctgggttcaagcgattcttgcgcctcagccttctcagtagcaggaattacaggtgcacaccaccatgcctggggcaacataactctactaaaaatacaaaaattagttgggatgtggtgggtgcatgcctatagttccagctattcggggagggctggatatgggcaggtttcacctggaaccggggtagggtcaaggctcncagtgagnccatgattgcaccacttgcanttcagctggggtgacagngttaag

SEQ ID NO: 377073 - DNA, 377 bp, Homo sapiens
tgaaaccacaagctgagtacaatcagtcaaggttgattaattccacttaaaccattaacacccttgtcagcagatcagaaccctgaggaaatagggaccctacagtttaatttgtgtttacatggcaagggggaaggagggtgactatcctaacccgtagggcacaatgaggacacctcaaccgccaagaatctggcgaaagggccacggccgtagtgagagagaagttggggagaatcctaccaatggaatacaggcaggcccagacaggagtttaaaagaacagaaaagaggatgtagtgtcacagacaaatttcacttgcatcagtcagagtttacctgaggccagtcttgtatagccaaatggagattagtaa

SEQ ID NO: 377074 - DNA, 863 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacaaaaagattaaatctggtcctttggggcccgcttgggccaattcttttttagactgagcaagcttatccttgcggccgcatttggggcttctttgccaatttcccctatagggg

SEQ ID NO: 377075 - DNA, 842 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaattaaaaaacataccacctcaaacaccttgt

SEQ ID NO: 377076 - DNA, 848 bp, Homo sapiens
aaaatggcaggagagccggggtaatcggcgagggttgaggcggagggagtatgggcttgtggatgtgtaatatcttgggtaaaaatcatggtgccaggcagggagcttgacccagcgtttcctgaaaatttctggaaaaacctgaagaaggaaaacatttgaccttggaataaactaaggttgaccttaaagctggtctggttgctcaccggaggagcgacaacgacccctaacagacgtaaggaatcgggaattaaacttggaatattgcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacaaaaaaaaaaaaaagcggggccattatgccgggcgcggcacagaggtctggaagggccttggcctaggggttcctgacccagttctggtcaaggggcacttgcgacccctataggggcggataatccgaaaccggtactagcacaccccg

SEQ ID NO: 377077 - DNA, 512 bp, Homo sapiens
tagctgctctgtgtagtttctcaccatatgagatatagaacgcccgtgggtggcataccgagtcgttctgaacgagaatccatatggcatgtctctgaggtctattcactgggatctgatctatagcaggacgtccagatgacgtacgctcgtatggtctacagagtttacgtccccggcacaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377078 - DNA, 995 bp, Homo sapiens
  misc_feature (838)..(838): n is a, c, g, or t
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacaacaaaaaaaaaacaaaaataacaaaaaaacaaaaaaaaaaaaacaaaaaaaaaaaaaaaaaaaaaaaaaaaaaaaaacaaaaaaaaanaacaaaagaaaaaaaaaaaaattaaaaaaaaaaaatttaattttactttattattaacttcattatattttaatcacattttacaatttcctctattttaatatactctcctactccccttattttacccttatacttttttctttcctcctcttcc

SEQ ID NO: 377079 - DNA, 1079 bp, Homo sapiens
aaaatggcaggagagccggggtaatcggcgagggttgaggcggagggagtatgggcttgtggatgtgtaatatcttgggtaaaaatcatggtgccaggcagggagcttgacccagcgtttcctgaaaatttctggaaaaacctgaagaaggaaaacatttgaccttggaataaactaaggttgaccttaaagctggtctggttgctcaccggaggagcgacaacgacccctaacagacgcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaatgaaaaaaaaaaaaaaaaaaaaaaaaaaaaaaaaaaaaaaaaaaaccggggcggggggggggtgcacccggggggggggggggcccaagcgccaaaaagggggggagagacagacaccagcgagactcacgcagatgaggacagcggatgaaaaaaggtgagaatcgaacaaaaaggagggaaaagaaacgggtttaccccgcgggaccaacggtaaaagagaggtactcatcccacgggcaccacgaggggccccagttgaggaggaggattccgacaatattggaaagacagaagttaatcaaacacggagagaagaaaggcgtgtgtacaacgggaacggggagt

SEQ ID NO: 377080 - DNA, 2613 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggtaaatgggagctgcagtggaactattttttatagtgtgcagtggagggaaaagaagtaattctggagtattaaaagtcgcttattaagtagagtttatgtcgttttcaagatcattaactgctttggttctaatctgtttcttaaagggaaatgactaatataaagttgcttattttatatgaccaatgctatgatgcttattttatgtgatagtttcagagtattaaaaattgtcctcaataggccgggtgcggtggctctcgcctgtaatctcagcactttgggaggccgaggtgtgcggatcacaaggtcaggagttcaagaccagcctgaccaacatggtgaaaccccgtctctactaaagatacaaaaattagccgggtgtggtggcatgcgcctgtaatcccagctactggggaggctgaggcaggagaatcatttgaaccctggaggcggaggttgcaaggagccgaggttgcaaggcgcccctgcattccagtatgggggacagggcgagattctgtctcaaaaaaaaaaaaaaaaaaatcccctcaatagcaatttggtagcctagtgtgatcagtgtttgccttacattctaaatttttaataagacaaaagaggctgtgcgtggtggctcacacctgtaatccttgcattttgggaggccaaagcaggaggatcgtttgagctcaggattcaaaatcaggagttcaaaatcagtctgggcaacataatgagacctcctgtctacaaaataaataaatacaaaagatgtgcttcaaggtaaaatgagggggcatttaagaattgagaggaaacttggactgttcgtttaacccctaacacattgaaattgccctaatcttaaccagttggtatacctggttgtatacctaccagaggaacaggttggtcagtcttgtccaatctgcagcctgggacagctctgaatgccgcctaacgcaaatccctaaactttcttaaaacctgatatttcttttgcaattttttttaagcttaccagctactgctaatgttagtgtattttatgtgtggcccaacacagttcttccagtgtggcccagggaagccaaaagattgcacacctctgttttagatgttcctcagttaattgtttaggcctcgggcttctaaagatctcagccaaaatacacagtaaacgccgttggggccaaataatgttaactgcattgttctagttgcttctgaggaggaaagctctactgaggagctgtcatggagttaggaataggaagactttggggagtggacacttagctgcagtccctttccccaaatctgttctttggagggaacaaaacaatcacaagagtatgttctaaatccaaaaaaactttaaatttttgtatgttgaaagaaggaaaatatgaccatttgtatatggcattttctgggtgctggctactgttgcaggtttatttcatatagttgataagttatgttaatatttaacagttataaagttagctttagttaactaaagttagcttttccagaatattttcttgaacttttacgttggagtcaggttttagtttaagccactgtgtattatttcaaagtgtaactacagtggtatttttgagtgaagatctgtaattctagtatgagtcgtatcacttagccacgaaatatatttttaatataattggatttgagtgaccatgtttcattagttgtagtgatttaaaagttaactgtttatgttgggtgaactagatatctttgctaataaacatccttccttttttaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377081 - DNA, 2851 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggtaaatgggagctgcagtggaactattttttatagtgtgcagtggagggaaaagaagtaattctggagtattaaaagtcgcttattaagtagagtttatgtcgttttcaagatcattaactgctttggttctaatctgtttcttaaagggaaatgactaatataaagttgcttattttatatgaccaatgctatgatgcttattttatgtgatagtttcagagtattaaaaattgtcctcaataggccgggtgcggtggctctcgcctgtaatctcagcactttgggaggccgaggtgtgcggatcacaaggtcaggagttcaagaccagcctgaccaacatggtgaaaccccgtctctactaaagatacaaaaattagccgggtgtggtggcatgcgcctgtaatcccagctactggggaggctgaggcaggagaatcatttgaaccctggaggcggaggttgcaaggagccgaggttgcaaggcgcccctgcattccagtatgggggacagggcgagattctgtctcaaaaaaaaaaaaaaaaaaatcccctcaatagcaatttggtagcctagtgtgatcagtgtttgccttacattctaaatttttaataagacaaaagaggctgtgcgtggtggctcacacctgtaatccttgcattttgggaggccaaagcaggaggatcgtttgagctcaggattcaaaatcaggagttcaaaatcagtctgggcaacataatgagacctcctgtctacaaaataaataaatacaaaagatgtgcttcaaggtaaaatgagggggcatttaagaattgagaggaaacttggactgttcgtttaacccctaacacattgaaattgccctaatcttaaccagttggtatacctggttgtatacctaccagaggaacaggttggtcagtcttgtccaatctgcagcctgggacagctctgaatgccgcctaacgcaaatccctaaactttcttaaaacctgatatttcttttgcaattttttttaagcttaccagctactgctaatgttagtgtattttatgtgtggcccaacacagttcttccagtgtggcccagggaagccaaaagattgcacacctctgttttagatgttcctcagttaattgtttaggcctcgggcttctaaagatctcagccaaaatacacagtaaacgccgttggggccaaataatgttaactgcattgttctagttgcttctgaggaggaaagctctactgaggagctgtcatggagttaggaataggaagactttggggagtggacacttagctgcagtccctttccccaaatctgttctttggagggaacaaaacaatcacaagagtatgttctaaatccaaaaaaactttaaatttttgtatgttgaaagaaggaaaatatgaccatttgtatatggcattttctgggtgctggctactgttgcaggtttatttcatatagttgataagttatgttaatatttaacagttataaagttagctttagttaactaaagttagcttttccagaatattttcttgaacttttacgttggagtcaggttttagtttaagccactgtgtattatttcaaagtgtaactacagtggtatttttgagtgaagatctgtaattctagtatgagtcgtatcacttagccacgaaatatatttttaatataattggatttgagtgaccatgtttcattagttgtagtgatttaaaagttaactgtttatgttgggtgaactagatatctttgctaataaacatccttccttttttaagggtggagagattcaaccagttagcgtgaaagttggagataaagttcttctcccagaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacaaaaaaaaacaaaaaagaaaaaaatataaagaaaaaaaaacaaaaacaaaaaaaagaaaccaaaaaaacaaaaagaaaaagaaaagaagaggaaagaagaagcgaaaacaaaacgagaagaagagcggcaggaggaacacagcgaggaagggagagcgcagcgcggaacacgcacgaggcctggggcgaatgagggggagcgcaggggaggcagagcggaa

SEQ ID NO: 377082 - DNA, 2718 bp, Homo sapiens
aaaatggcaggagagccggggtaatcggcgagggttgaggcggagggagtatgggcttgtggatgtgtaatatcttgggtaaaaatcatggtgccaggcagggagcttgacccagcgtttcctgaaaatttctggaaaaacctgaagaaggaaaacatttgaccttggaataaactaaggttgaccttaaagctggtctggttgctcaccggaggagcgacaacgacccctaacagacgtaaggaatcgggaattaaacttggaatattggttagtacattcaaatgcgcttccttaacgaataagctgaggtttggtgttaactttcaaagccaaaacgtgttgagatgtatagcacggtggcgttgcctgttgataatgtgattacatttagtttttgtttcaaaacatttctcttcctacaggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggtaaatgggagctgcagtggaactattttttatagtgtgcagtggagggaaaagaagtaattctggagtattaaaagtcgcttattaagtagagtttatgtcgttttcaagatcattaactgctttggttctaatctgtttcttaaagggaaatgactaatataaagttgcttattttatatgaccaatgctatgatgcttattttatgtgatagtttcagagtattaaaaattgtcctcaataggccgggtgcggtggctctcgcctgtaatctcagcactttgggaggccgaggtgtgcggatcacaaggtcaggagttcaagaccagcctgaccaacatggtgaaaccccgtctctactaaagatacaaaaattagccgggtgtggtggcatgcgcctgtaatcccagctactggggaggctgaggcaggagaatcatttgaaccctggaggcggaggttgcaaggagccgaggttgcaaggcgcccctgcattccagtatgggggacagggcgagattctgtctcaaaaaaaaaaaaaaaaaaatcccctcaatagcaatttggtagcctagtgtgatcagtgtttgccttacattctaaatttttaataagacaaaagaggctgtgcgtggtggctcacacctgtaatccttgcattttgggaggccaaagcaggaggatcgtttgagctcaggattcaaaatcaggagttcaaaatcagtctgggcaacataatgagacctcctgtctacaaaataaataaatacaaaagatgtgcttcaaggtaaaatgagggggcatttaagaattgagaggaaacttggactgttcgtttaacccctaacacattgaaattgccctaatcttaaccagttggtatacctggttgtatacctaccagaggaacaggttggtcagtcttgtccaatctgcagcctgggacagctctgaatgccgcctaacgcaaatccctaaactttcttaaaacctgatatttcttttgcaattttttttaagcttaccagctactgctaatgttagtgtattttatgtgtggcccaacacagttcttccagtgtggcccagggaagccaaaagattgcacacctctgttttagatgttcctcagttaattgtttaggcctcgggcttctaaagatctcagccaaaatacacagtaaacgccgttggggccaaataatgttaactgcattgttctagttgcttctgaggaggaaagctctactgaggagctgtcatggagttaggaataggaagactttggggagtggacacttagctgcagtccctttccccaaatctgttctttggagggaacaaaacaatcacaagagtatgttctaaatccaaaaaaactttaaatttttgtatgttgaaagaaggaaaatatgaccatttgtatatggcattttctgggtgctggctactgttgcaggtttatttcatatagttgataagttatgttaatatttaacagttataaagttagctttagttaactaaagttagcttttccagaatattttcttgaacttttacgttggagtcaggttttagtttaagccactgtgtattatttcaaagtgtaactacagtggtatttttgagtgaagatctgtaattctagtatgagtcgtatcacttagccacgaaatatatttttaatataattggatttgagtgaccatgtttcattagttgtagtgatttaaaagttaactgtttatgttgggtgaactagatatctttgctaataaacatccttccttttttaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377083 - DNA, 650 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatgaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377084 - DNA, 759 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377085 - DNA, 1396 bp, Homo sapiens
tagacaccagatagtcatccatgataatattacatagtcataaagatgtacacacagactactgatttcttgacaaggtgatagaaaacaccaagaggatgaggggagggaggcacatgtgcatgaggaaggcacagtaagaaagctgaatcctcaaccagggcgggaagtcagttctccaaatcccaagctaagaagtcaagacagatagacaaagttatttaaaaacacagcggcaaatacccaaagaaacttttaaatatgtaaatgtggtcgactgtagagacagtgaatcaagtgttgggcgataacatcacgtgatgttatcgcccaacacagttcttccagtgtggcccagggaagccaaaagattgcacacctctgttttagatgttcctcagttaattgtttaggcctcgggcttctaaagatctcagccaaaatacacagtaaacgccgttggggccaaataatgttaactgcattgttctagttgcttctgaggaggaaagctctactgaggagctgtcatggagttaggaataggaagactttggggagtggacacttagctgcagtccctttccccaaatctgttctttggagggaacaaaacaatcacaagagtatgttctaaatccaaaaaaactttaaatttttgtatgttgaaagaaggaaaatatgaccatttgtatatggcattttctgggtgctggctactgttgcaggtttatttcatatagttgataagttatgttaatatttaacagttataaagttagctttagttaactaaagttagcttttccagaatattttcttgaacttttacgttggagtcaggttttagtttaagccactgtgtattatttcaaagtgtaactacagtggtatttttgagtgaagatctgtaattctagtatgagtcgtatcacttagccacgaaatatatttttaatataattggatttgagtgaccatgtttcattagttgtagtgatttaaaagttaactgtttatgttgggtgaactagatatctttgctaataaacatccttccttttttaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377086 - DNA, 784 bp, Homo sapiens
tccggttcagctcctgcctgatggccatcacagcctgttgcctaagccccttcatgttgcgcatgtgtctgtagaagctcccagcgcacagcttgaatgtcgctagcagcattgtttccttggcaaatgtgccagtggtggggtcgctgccgctgctgctgccgccgctgctgctgcctcttctctcaagggtggtctttcgtccttcctgagcccctcaagcttcgcctctgagctcgtgcgaatttcggcacgagctagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattataataaactaatgataactaatgacaaaaagattaaatctggtcctttggggcccgcttgggccaattcttttttagactgagcaagcttatccttgcggccgcatttggggcttctttgccaatttcccctatagggg

SEQ ID NO: 377087 - DNA, 693 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaggaaaaattccaaacaggacagtgccgaaacagaagtaatcatgaggaaagctggaggccggtcactgactaggagatttctctcttcgaatgaaaatagaacatgagcgatagcgaatg

SEQ ID NO: 377088 - DNA, 1161 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaatgaaaaaaaaaaaaaaaaaaaaaaaaaaaaaaaaaaaaaaaaaaaccggggcggggggggggtgcacccggggggggggggggcccaagcgccaaaaagggggggagagacagacaccagcgagactcacgcagatgaggacagcggatgaaaaaaggtgagaatcgaacaaaaaggagggaaaagaaacgggtttaccccgcgggaccaacggtaaaagagaggtactcatcccacgggcaccacgaggggccccagttgaggaggaggattccgacaatattggaaagacagaagttaatcaaacacggagagaagaaaggcgtgtgtacaacgggaacggggagt

SEQ ID NO: 377089 - DNA, 812 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377090 - DNA, 965 bp, Homo sapiens
  misc_feature (808)..(808): n is a, c, g, or t
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacaaaaaaaaaaaaaacaaaaaaaaaaaaaaaaaaaaaaaaaaaaaaaaacaaaaaaaaanaacaaaagaaaaaaaaaaaaattaaaaaaaaaaaatttaattttactttattattaacttcattatattttaatcacattttacaatttcctctattttaatatactctcctactccccttattttacccttatacttttttctttcctcctcttcc

SEQ ID NO: 377091 - DNA, 970 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacaaaaaaaaacaaaaaagaaaaaaatataaagaaaaaaaaacaaaaacaaaaaaaagaaaccaaaaaaacaaaaagaaaaagaaaagaagaggaaagaagaagcgaaaacaaaacgagaagaagagcggcaggaggaacacagcgaggaagggagagcgcagcgcggaacacgcacgaggcctggggcgaatgagggggagcgcaggggaggcagagcggaa

SEQ ID NO: 377092 - DNA, 809 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattataataaactaatgataactaatgacaaaaagattaaatctggtcctttggggcccgcttgggccaattcttttttagactgagcaagcttatccttgcggccgcatttggggcttctttgccaatttcccctatagggg

SEQ ID NO: 377093 - DNA, 884 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaataggccgggtgcggtggctctcgcctgtaatctcagcactttgggaggccgaggtgtgcggatcacaaggaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377094 - DNA, 892 bp, Homo sapiens
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaa

SEQ ID NO: 377095 - DNA, 833 bp, Homo sapiens
  misc_feature (676)..(676): n is a, c, g, or t
gcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgacggctggggcgagcgcgcctgcgcgctgggtgattttttcacgtgtcgccagggccggactgcgagtctctttgcggcgctacactagagcagagtacgagtctgaggcggagggagtaatgaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacaacaaaaaaaaaacaaaaataacaaaaaaacaaaaaaaaaaaaacaaaaaaaaaaaaaaaaaaaaaaaaaaaaaaaaacaaaaaaaaanaacaaaagaaaaaaaaaaaaattaaaaaaaaaaaatttaattttactttattattaacttcattatattttaatcacattttacaatttcctctattttaatatactctcctactccccttattttacccttatacttttttctttcctcctcttcc

SEQ ID NO: 377096 - DNA, 788 bp, Homo sapiens
gcgagtctctttgcggcgctacactagagcagagtacgagtctgaggcggagggagtaatggtgagtcccgcgtggccccgaggcctgcaggcccgggcctgtctgaggcgtacggggatccctgacgcccctcttttgttgggctgggcgggagggattggtggccactcagtgaccagcgcccgatggcaccttggagcggcaaggcccgcccgacccttttctcccccagggctctttgcacgcgcgtgtgctgccggtgtgtaaggcaggggggcgagaacccgggcgcacgcgcagcgtctcacctgcttctgcagggcctttgtggatgtgtaatatcttgggtaaaaatcatggtgccaggcagggagcttgacccagcgtttcctgaaaatttctggaaaaacctgaagaaggaaaacatttgaccttggaataaactaaggttgaccttaaagctggtctggttgctcaccggaggagcgacaacgacccctaacagacgtaaggaatcgggaattaaacttggaatattggttagtacattcaaatgcgcttccttaacgaataagctgaggtttggtgttaactttcaaagccaaaacgtgttgagatgtatagcacggtggcgttgcctgttgataatgtgattacatttagtttttgtttcaaaacatttctcttcctacaggcaggacaagcgtttagaaagtttcttccactctttgaccgagtattggttgaaaggagtgctgctgaaactgtaaccaaaggaggcattatg

SEQ ID NO: 377097 - DNA, 468 bp, Homo sapiens
ctgggtgctgagataagagtaatctggtggcagtctctcttgttagttttcaggggagaagaagaaattctggagctgctgctgggagggatgtgggagaatttgtctttcatgatacgctgtatgtccacgcagtcacctcattcttgttccctttctcaacttctcttatatgcagataagcacaaacgggacacatgtccagctcatactgctaatgaagtttcagaaatttctgttacaactgtttcccctccagaaaagaaaaacgttatgttcttagttttaaatagtttctctggagtcattgttgtgattgaactctatttacacgagctgtaactcatgacagttctcaaactttcgtgacagaaaacccaactcttttactccaaagcccatatagcacccacaactattaactgtgaccaagaaagagaaggcaagccccaattaacctttgtacgt

SEQ ID NO: 377098 - DNA, 427 bp, Homo sapiens
cactgacctctgtcctcatctcagtatagcttcccttctcacttgctgcattattcagtttcttatcatcgaccatggatcttgtaatgccatcggtactatttttttttgaaggctatatctttaagtagatggcaatattccatcattcactttttataaaattgaagctgcaggtggccgggtgcagtggctcatgcctgtaatcccagcactttgggagcccgaggtgggcagatcacgaggtcaggagatcgagaccatcctggctaacatggtgaaaccccgtctctactaaaaatacaaaaattagccgggcgtggtggtgggcgcctctagtcccagctacctgggaggctgaggcaggagaatggcgtgaatccgggaggtggagcttgcagtgagccgagatcgcgccactgcactc

SEQ ID NO: 377099 - DNA, 369 bp, Homo sapiens
gaatgataggtgaggagttatttttctctcagaattttgaaggctttgtctccttgcctttgttctttcagtatggattttaagaagttcaattttattttgattgttgatcttttatatgaaaccagaaacacataggatcttctctttgcatccagggttctacaataatactgtgagggactttggtatgagtccgtttaaactcatgcccttttgttctcggaagtccttttgaattatttcatcctctctctctgtctctctctctctctctctctctccatctgtgtgtgtgtgtgtttgtgtgtttgtgtgtgtgtgtgttgtgtgtgggcaggggagctcccctatactgtggtactcata

SEQ ID NO: 377100 - DNA, 1399 bp, Homo sapiens
  misc_feature (939)..(939): n is a, c, g, or t
  misc_feature (1399)..(1399): n is a, c, g, or t
ctgttttgatgtcttaggacaagtcattggccctttcctctgatgctttgaagtaggagtgctgtttttgatttccttcttacttctcgatttaagaaagtgtaggcatctatttggtgaggggtttcctaggctattcagaaaggactaatctccctcatgacctctttctcttctctagctcctcaaaactctaccctttcccaagataccccagaggaagaccccagaggaaaacatgctttccagacaggatggctaaatgacttggtgaccaaagtgagtgtgactgtcttttctgattttaaaatgccttcttagtgtgtgaggacattttctgacctggccctataactactgtgcccccagaagctctatcaaggacttaagccccagtttctctcctatgttatcttggtctgttaaggtaggtgaatgtactataaagaaaaggtgcttccattgccttcccttgatatgtctttccttactttgactttgtcagcaatatcacatagagaatacgagattgacctccacagccagatggatttaggttttgtttcccggctctaccattggaactgcaatttgggacaagatacttaacctctcttagcctgagttattctactctcataaatagaatttacctcttaggttgtgagtattaaatattatgagacttgtagttagcctggattacagttaagcaattaatagatgattgttactattatttttcctcattaacaagtagttaaaggccatgcattctgtcatattactgttggtcatgaatttatatatattttttgagacagagtcgcactctgttgcccaggctggagtgcagtggtgcgatcttggtccacggcagcctccacctcctgggttcaagtgattctcatgccacagcctctggagtagctggggttncaggtgcatgccaccatgcctggctaatttttgtatttttagtagagacagggtttcgccatgttgctcatgctggtcttgaactcctgacctcaggtgatccacccgtgttggcctcccaaagtgctgggattacatgtgtgagccaccgcgcccggccatgagtctatattattttaaagaatagtaactcaagataccttaagagaaagatttactgtaaaaatataactggtttttctgaaattggaaagcttttggtaaccaagttaaaatgattattcattgatagtgtgaacatttacctggaaagcctaacaaaatcaagggaaaaagtgttagaaacactaatagaaaaattggataaaatgactacagaaaatgacatgcaaaaatcaatcacttacatatatatacttatatatatatctacatatatacatataaaaatgagataaan

SEQ ID NO: 377101 - DNA, 2822 bp, Homo sapiens
aggataaaattctttatattcctcctgaacaggacttacagtgtacagaccaactgtgattcccatattggaagaaccatggatggtgataaaagaaattttagaaggccctagtccagaatgggaaactaaagcccaagcatgtactccagtggaggatatgtctaaactcacaaaggaagaaacccataccatcaaattagaagactcatatgactacgatgatagactagagaggcgaggaaaaggtggcttctggaaaattcacactgatgaaagaggtttcagtttgaagtcagtcctttcacaagaatatgatcctacagaagaatgtcttagtaaatatgatatatatagaaataattttgaaaagcattcaaacctaattgtacagtttgatacccaattagataataaaacttctgtgtataatgaaggcagggcaaccttcaatcatgtctcatatggtattgtacataggaaaatacttcctggagagaagccttacaagtgtaatgtgtgtgggaaaaaatttaggaaatacccatccctcctgaaacaccaaagtacccatgccaaagagaaatcgtatgaatgtgaagaatgtgggaaagagtttaggcatatctcatcccttattgcacatcagagaatgcacactggagaaaaaccatatgaatgccaccagtgtggtaaagccttcagccagcgtgcacaccttactatacatcagagaattcatactggagagaaaccctataagtgtgatgactgtgggaaagacttcagtcagcgtgcacaccttaccatccatcaaaggacacatactggagagaaaccatataaatgcttggaatgtggtaaaaccttcagtcatagttcatcactgattaatcatcagagagttcatactggagaaaaaccttatatatgcaatgaatgtgggaagactttcagtcagagtacacaccttcttcagcatcaaaaaatacatactgggaagaaaccatataaatgcaatgaatgttggaaagtgtttagtcagagtacttaccttattcgacatcagagaattcattctggagagaagtgttataaatgtaatgaatgtggaaaagcctttgctcattcctcaacccttattcaacatcaaaccactcacactggagagaaatcctatatatgtaatatatgtgggaaagccttcagccagagtgcaaatcttactcaacatcatagaacacatactggagagaaaccatataaatgcagtgtgtgtgggaaagcattcagccagagtgtgcaccttactcaacatcagaggattcataatggagaaaaaccctttaaatgcaatatatgtgggaaagcatatagacaaggcgcaaatcttactcagcatcaaaggattcatactggagaaaaaccctataaatgtaatgaatgtgggaaagctttcatttattcctcatcacttaatcaacatcagagaactcatactggagagagaccctataaatgtaatgaatgtgataaggattttagccagagaacatgccttattcaacaccagagaattcacacaggagagaaaccctatgcatgtcgtatatgtggtaaaaccttcacccagagtacaaaccttattcagcatcaacgtgttcatacaggtgccaaacatcgtaattaatggataagggaaacttcaattcggttttacaactttgtttcaattttgttttgtgcattctatgtgtcagaacattcagaagaagtctgaagaagtgcaatatgttagatactcagcagaagtatcagaagtagtggtatggatataacctatttagatttaatgtgaaatttaagaaggaaacttgacttcttaaccttaatttgatatgattttaattcattacagaaagaaaccctgtgaagggtattcaaaaacataactcatcaactctctatttcaagtacacttatcctttggtatactcgggggattggttccaggaccacccatgtatacgaaaatctacccatactcaagttgcacggtcagcctggtggaacctgtgtatatgaaaagccctacatctatgcaggtttcccatccctgaataatgtgctttcaaactctgttcagttgaaaaaaaaaattccagtataaatggatctgtacagttcaaatgtgttgttcaagggtcaactgtacatcctaatgaggccttatgagtgtaacttaggaaggtgtccatcaaatagagatttcacactagagagtgatcttaaaattacagaaaagagtaagctgctttcaggccttttattcccagctttgaagccttaaaatatgtaaaggactcccttccctgttttacttccccttctcctgttatgccataactgccatatggagccagtaggtttgaaaaaaaaacagttggaagtatcttaaagatttctatgtgaccactggttacaccttccctcagatatggaaatattaaagagaagcttaatgaaagatatgttatgatagaaactaatgtgtatataacattagatgtgtagagatttagttaaacaggcaaaaattaaatgcctcaagcttaaatgaattttcaatacacattagccttgatttcactaggttttgacattcaaggtcatcctgaaggaaaaaagtaggtataaagtatacagttcccatttttttcacctgactcctaaatttatactttaggtttctctgtgactgttttactatggaaagttcatttcttccactgaaacacgtttcttgagtgtctactatgctc

SEQ ID NO: 377102 - DNA, 4077 bp, Homo sapiens
atgcgcagtgacgccgaggcgaggtcgcggctaagcagaggcgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacaggtattgatgtccgggcgcagcgcgcgagtgtccgcgcgatcagtgacagcccgagcccgtccacgcgcgggctcccgtgctcgtggcttgcgggagggcaaagacggggtggaggctgctgtgggcccagtcccagcgttgcgcgtcgcacggtccccgactcccccgctgccctcgacctcgaccctgcggctgaagaggaggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacccagacctggctggtcctcgaaaggcattgagtcaactccgagagctctgccttaagtggctgagacctgagattcactcaaaggaacaaattttggagctgctggtgctggagcaattcctgaccatcctgcctggtgaggttaggacttgggtaaagtcccagtatccagagagcagcgaggaagcagtgactctggtggaggatttgactcagattctagaagaggaagctcctcaaaactctaccctttcccaagataccccagaggaagaccccagaggaaaacatgctttccagacaggatggctaaatgacttggtgaccaaagaatcgatgacattcaaagatgtggctgtagacatcacccaggaggactgggagttaatgcgtcctgtgcagaaggaattatacaagactgtgacgttacagaactattggaacatggtttctctgggacttacagtgtacagaccaactgtgattcccatattggaagaaccatggatggtgataaaagaaattttagaaggccctagtccagaatgggaaactaaagcccaagcatgtactccagtggaggatatgtctaaactcacaaaggaagaaacccataccatcaaattagaagactcatatgactacgatgatagactagagaggcgaggaaaaggtggcttctggaaaattcacactgatgaaagaggtttcagtttgaagtcagtcctttcacaagaatatgatcctacagaagaatgtcttagtaaatatgatatatatagaaataattttgaaaagcattcaaacctaattgtacagtttgatacccaattagataataaaacttctgtgtataatgaaggcagggcaaccttcaatcatgtctcatatggtattgtacataggaaaatacttcctggagagaagccttacaagtgtaatgtgtgtgggaaaaaatttaggaaatacccatccctcctgaaacaccaaagtacccatgccaaagagaaatcgtatgaatgtgaagaatgtgggaaagagtttaggcatatctcatcccttattgcacatcagagaatgcacactggagaaaaaccatatgaatgccaccagtgtggtaaagccttcagccagcgtgcacaccttactatacatcagagaattcatactggagagaaaccctataagtgtgatgactgtgggaaagacttcagtcagcgtgcacaccttaccatccatcaaaggacacatactggagagaaaccatataaatgcttggaatgtggtaaaaccttcagtcatagttcatcactgattaatcatcagagagttcatactggagaaaaaccttatatatgcaatgaatgtgggaagactttcagtcagagtacacaccttcttcagcatcaaaaaatacatactgggaagaaaccatataaatgcaatgaatgttggaaagtgtttagtcagagtacttaccttattcgacatcagagaattcattctggagagaagtgttataaatgtaatgaatgtggaaaagcctttgctcattcctcaacccttattcaacatcaaaccactcacactggagagaaatcctatatatgtaatatatgtgggaaagccttcagccagagtgcaaatcttactcaacatcatagaacacatactggagagaaaccatataaatgcagtgtgtgtgggaaagcattcagccagagtgtgcaccttactcaacatcagaggattcataatggagaaaaaccctttaaatgcaatatatgtgggaaagcatatagacaaggcgcaaatcttactcagcatcaaaggattcatactggagaaaaaccctataaatgtaatgaatgtgggaaagctttcatttattcctcatcacttaatcaacatcagagaactcatactggagagagaccctataaatgtaatgaatgtgataaggattttagccagagaacatgccttattcaacaccagagaattcacacaggagagaaaccctatgcatgtcgtatatgtggtaaaaccttcacccagagtacaaaccttattcagcatcaacgtgttcatacaggtgccaaacatcgtaattaatggataagggaaacttcaattcggttttacaactttgtttcaattttgttttgtgcattctatgtgtcagaacattcagaagaagtctgaagaagtgcaatatgttagatactcagcagaagtatcagaagtagtggtatggatataacctatttagatttaatgtgaaatttaagaaggaaacttgacttcttaaccttaatttgatatgattttaattcattacagaaagaaaccctgtgaagggtattcaaaaacataactcatcaactctctatttcaagtacacttatcctttggtatactcgggggattggttccaggaccacccatgtatacgaaaatctacccatactcaagttgcacggtcagcctggtggaacctgtgtatatgaaaagccctacatctatgcaggtttcccatccctgaataatgtgctttcaaactctgttcagttgaaaaaaaaaattccagtataaatggatctgtacagttcaaatgtgttgttcaagggtcaactgtacatcctaatgaggccttatgagtgtaacttaggaaggtgtccatcaaatagagatttcacactagagagtgatcttaaaattacagaaaagagtaagctgctttcaggccttttattcccagctttgaagccttaaaatatgtaaaggactcccttccctgttttacttccccttctcctgttatgccataactgccatatggagccagtaggtttgaaaaaaaaacagttggaagtatcttaaagatttctatgtgaccactggttacaccttccctcagatatggaaatattaaagagaagcttaatgaaagatatgttatgatagaaactaatgtgtatataacattagatgtgtagagatttagttaaacaggcaaaaattaaatgcctcaagcttaaatgaattttcaatacacattagccttgatttcactaggttttgacattcaaggtcatcctgaaggaaaaaagtaggtataaagtatacagttcccatttttttcacctgactcctaaatttatactttaggtttctctgtgactgttttactatggaaagttcatttcttccactgaaacacgtttcttgagtgtctactatgctc

SEQ ID NO: 377103 - DNA, 3875 bp, Homo sapiens
atgcgcagtgacgccgaggcgaggtcgcggctaagcagaggcgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacagggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacccagacctggctggtcctcgaaaggcattgagtcaactccgagagctctgccttaagtggctgagacctgagattcactcaaaggaacaaattttggagctgctggtgctggagcaattcctgaccatcctgcctggtgaggttaggacttgggtaaagtcccagtatccagagagcagcgaggaagcagtgactctggtggaggatttgactcagattctagaagaggaagctcctcaaaactctaccctttcccaagataccccagaggaagaccccagaggaaaacatgctttccagacaggatggctaaatgacttggtgaccaaagaatcgatgacattcaaagatgtggctgtagacatcacccaggaggactgggagttaatgcgtcctgtgcagaaggaattatacaagactgtgacgttacagaactattggaacatggtttctctgggacttacagtgtacagaccaactgtgattcccatattggaagaaccatggatggtgataaaagaaattttagaaggccctagtccagaatgggaaactaaagcccaagcatgtactccagtggaggatatgtctaaactcacaaaggaagaaacccataccatcaaattagaagactcatatgactacgatgatagactagagaggcgaggaaaaggtggcttctggaaaattcacactgatgaaagaggtttcagtttgaagtcagtcctttcacaagaatatgatcctacagaagaatgtcttagtaaatatgatatatatagaaataattttgaaaagcattcaaacctaattgtacagtttgatacccaattagataataaaacttctgtgtataatgaaggcagggcaaccttcaatcatgtctcatatggtattgtacataggaaaatacttcctggagagaagccttacaagtgtaatgtgtgtgggaaaaaatttaggaaatacccatccctcctgaaacaccaaagtacccatgccaaagagaaatcgtatgaatgtgaagaatgtgggaaagagtttaggcatatctcatcccttattgcacatcagagaatgcacactggagaaaaaccatatgaatgccaccagtgtggtaaagccttcagccagcgtgcacaccttactatacatcagagaattcatactggagagaaaccctataagtgtgatgactgtgggaaagacttcagtcagcgtgcacaccttaccatccatcaaaggacacatactggagagaaaccatataaatgcttggaatgtggtaaaaccttcagtcatagttcatcactgattaatcatcagagagttcatactggagaaaaaccttatatatgcaatgaatgtgggaagactttcagtcagagtacacaccttcttcagcatcaaaaaatacatactgggaagaaaccatataaatgcaatgaatgttggaaagtgtttagtcagagtacttaccttattcgacatcagagaattcattctggagagaagtgttataaatgtaatgaatgtggaaaagcctttgctcattcctcaacccttattcaacatcaaaccactcacactggagagaaatcctatatatgtaatatatgtgggaaagccttcagccagagtgcaaatcttactcaacatcatagaacacatactggagagaaaccatataaatgcagtgtgtgtgggaaagcattcagccagagtgtgcaccttactcaacatcagaggattcataatggagaaaaaccctttaaatgcaatatatgtgggaaagcatatagacaaggcgcaaatcttactcagcatcaaaggattcatactggagaaaaaccctataaatgtaatgaatgtgggaaagctttcatttattcctcatcacttaatcaacatcagagaactcatactggagagagaccctataaatgtaatgaatgtgataaggattttagccagagaacatgccttattcaacaccagagaattcacacaggagagaaaccctatgcatgtcgtatatgtggtaaaaccttcacccagagtacaaaccttattcagcatcaacgtgttcatacaggtgccaaacatcgtaattaatggataagggaaacttcaattcggttttacaactttgtttcaattttgttttgtgcattctatgtgtcagaacattcagaagaagtctgaagaagtgcaatatgttagatactcagcagaagtatcagaagtagtggtatggatataacctatttagatttaatgtgaaatttaagaaggaaacttgacttcttaaccttaatttgatatgattttaattcattacagaaagaaaccctgtgaagggtattcaaaaacataactcatcaactctctatttcaagtacacttatcctttggtatactcgggggattggttccaggaccacccatgtatacgaaaatctacccatactcaagttgcacggtcagcctggtggaacctgtgtatatgaaaagccctacatctatgcaggtttcccatccctgaataatgtgctttcaaactctgttcagttgaaaaaaaaaattccagtataaatggatctgtacagttcaaatgtgttgttcaagggtcaactgtacatcctaatgaggccttatgagtgtaacttaggaaggtgtccatcaaatagagatttcacactagagagtgatcttaaaattacagaaaagagtaagctgctttcaggccttttattcccagctttgaagccttaaaatatgtaaaggactcccttccctgttttacttccccttctcctgttatgccataactgccatatggagccagtaggtttgaaaaaaaaacagttggaagtatcttaaagatttctatgtgaccactggttacaccttccctcagatatggaaatattaaagagaagcttaatgaaagatatgttatgatagaaactaatgtgtatataacattagatgtgtagagatttagttaaacaggcaaaaattaaatgcctcaagcttaaatgaattttcaatacacattagccttgatttcactaggttttgacattcaaggtcatcctgaaggaaaaaagtaggtataaagtatacagttcccatttttttcacctgactcctaaatttatactttaggtttctctgtgactgttttactatggaaagttcatttcttccactgaaacacgtttcttgagtgtctactatgctc

SEQ ID NO: 377104 - DNA, 614 bp, Homo sapiens
gattacaggcacacatcaccatgcccggctaatttttgtatttttagtagagacggggtttcaccatcttggcaaggctggtcttgaactcctgaccttgtgatccaactgtcttgcctcccaaagagctcggattacaggcgggagccaccgcgcccggccctttactggtcttttatagtcactttctctctaatcctttttaatctctttcctctttctttccatttgctcactttttccttttttacatgattttcgtggtgtctctgctctcgtattacctgtaacttcatttcttcatttctgaaatggttttgtctttttcttcagtttccttcctgaattctgtcatttcctaccacagactccgctgccatttggccacctcttccctgcgttcttattctgtgcttattctcctctgttcttattctgtgctgtagtctcccttcggagctgaagttcttgttggaatattagatcatgattttcatctggtttgtggcagtatttgtctgatgagatttcttcatttgtaggagaatagcactgcttttattttttatttttattttttaagactgcagcttgctctgtgacccaggctggag

SEQ ID NO: 377105 - DNA, 3531 bp, Homo sapiens
cgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctactcttgagatactgactggaagatagactgttttgttccacctgattgtatgggagaaatttttgaccttagaaagtggaaatgaggttgctatggaaactggtaattctgctgccactcataaactcttctgcaggtgatggtcttttaagccgtcctatttttactcaggagccacatgatgtcatttttcctttggatttatcaaaatctgaggtcatcctgaattgtgctgctaatggttacccttcgcctcattataggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatatattgaagactttgaaactaaaacaagaagcacagtatctgtccgagaaggtcaaggtgtggtgcttctctgtggcccaccgccacattttggagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtgtgatgggggaatatgaaccaaagattgaagtgcgttttcctgaaactatacaagctgcaaaggattcatctgtaaaactggaatgttttgcccttggaaatccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatgctcctccagaatgggaacagaaaatccaaaatacacacctctctatctatgacaacttgctctgggaatgtaaagctagtggaaagccaaacccttggtatacatggttaaaaaatggtgaacgactcaacccagaggagagaattcaaatagaaaatgggacactcatcataacgatgctgaatgtgtcagattctggtgtgtaccaatgtgctgcagaaaacaaatatcagataatttatgcaaatgctgaattgagagttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaagaatatttctcttggaggatggcagcctcaagatatataatattaccaggtcagatgctggatcatatacatgcatagccacaaatcagtttggcactgcaaagaacactggcagcctcattgtaaaagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagaatctgttggggatttgatgataaggaatattcagttacatcattcaggaaaatatctctgcacagtacaaacaaccctagaaagtttatctgcagtagccgatatcattgttagaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcagtccctgttgtggcaccagtaaacatccatggaggtggaggaagtcggtctgaactcgtcattacgtgggagtcaattccagaagaactgcagaatggggagggatttggatatatcatcatgttccggccagtgggctcgacaacctggtccaaggagaaagtatcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatgaacctcaactggccccaaggggaacttctctccagagtttttctgcttctgaaatggaggtttcatggaatgctattgcctggaatagaaacactggaagagtgctgggctatgaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaaca

SEQ ID NO: 377106 - DNA, 707 bp, Homo sapiens
aattaatatatttcaaatgacactgaagacattttagctccttctatgcaaatcatcgaagacttattttttcttttcatgttgatgcatcatactttgaccatgagctaattaacattcatttggatctttgattatctctttaaagctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaaca

SEQ ID NO: 377107 - DNA, 571 bp, Homo sapiens
catcactaatcaagtgtggctttcataaggagctgagtcacaactttcaagtcctcctcaaaacaattttctaagccaaccaacaccagtcagtcagagttagcaggcaataataatgtatcatttttgcattagaaaaatcacttactcatctgcctgaagctgtgattgagtgcaagtcattagcatccaatgttggccaatcctttaggcagactttgccaatttagggattttccttttgcatttttatacttaaatcagatgtccttggacaaagacacggtaaggcactttctaaaattaaatataatgtgaatgagacaagtataataaaatatgttactagaagagaaatgatagtatgaaattggggttttgaaaaattaatctaacaggcaatactttatctcaaaatatttttgtcttatttttatattttgcaggtttgagttccagaggaattcaattcttagaacctagcacccattttctttccattgtcattgtgatttttcactgttttgctattcagccacttatctgatgaataaaaccataaatctttgag

SEQ ID NO: 377108 - DNA, 504 bp, Homo sapiens
gataactacctgggtaaatatataagattattttcttcttatttaaagtaagagtgagattcttatcaacaatagcataaaggctgaaggggagaaatggaagtctattagtgtaatcttatacatgatgtggtatgatgtcacttgaatgtagaattataaagataaacagcataaactcttaaagcaaccaccaaaataacaaagagttataactaataattcagcaaaggagataaaatgaaattaggccaggtgaggtggctcacgcctgtaatcccagcactttgggaagctaaggcaggtggatcacttgaggtcaggagttcgggaccagcctggccaacgtggtgaaaccccatctctactaaaaatacaaaattagccaggtgtggtggcacacacctgtaatcccagttactcgggaggctgagacaggagaattgctggaacctaggaggtggaggttgcattgagccaagattgtgccactgcactccagca

SEQ ID NO: 377109 - DNA, 1864 bp, Homo sapiens
taacatcaaatggcacagcagtatgtctaaattgcccttaaagaaatacaaaatgggccgggcatgtggctcacacctgtaatcccagcactttgggatgccaagccaggcgaatcgcaaggtcaggaattcgagaccagcctggccaatatggtgaaacctcgtctctaccaaaaatacaaaaattagccaggcatggtggtgggcgcctgtagtctcagctactcgggaggctgaggcaggagaatctcttgaacctgggaggcagaggttgcagtgagccgagatcgcaccactgcactccagcctgggcgacagagtgagactccgtctcagaaatacaaaatgagtagtaaatttatctttgaaatctgcaaaacaaatgtaccctaaatgttataaataaaggtcagtaaatttaagttaaacagtgtgggggcaaaggatttttatcatctttatatccatttctctttttttatcctccccttttacacatagatgcgaatcagtagttgttgtttttggaatttgtgacactgtgagccattggctgtgcttccatatctggtttgttggccaaactttggagctatgtcgtttttcacctctcagatactaaggatgagcttccccatacttggcattagcctctgggatagtcagccaacgttatcttcttctagggacttggtactcaaccgagcactcaataagtgcttcattcaggtcatagctggactctgcattgttgattgtctctctgtctttcttttttttaaatttgagatattcacataccagaaaatttaccgtttaaacaatttagtgtttattaacatatttacagggaatatacaaccatcatcattatcttaatttgagaacacttttattactctaaaaagaaattgcctacccatcagcagtcacttcccattccttccttcccctacccactgggaactgctaatctacttttatctgtatggatttgactattctggacacttcatatacatggaatcatgcaatatgtggccttttgtgtctggtttctttcacttaacatgttttcaagccttgtctatgctatagtatattattacctcatttctttttatgcttacataaaattccattgtgtggtgtgccacagtttatccattcacctgttagtggacatttgggttgcttccaccttttggcagttgtgaataatactgcgaggaacatttgtatacaagtttttgtgtagacgtacgttttcctctttcttgtgtaaatacttaggagtgtaatggctaagtcatatggtagctaaatattaacattttaggaattgccaagctgttttccaaggcaactgcaccattttacattcccagtaacaacctgtgagcattcaaatttttccgtatcgtcaaccaacatttattattatctttctcattgtggtaaaatgtctattcagattctgacattttagcttttgatataatcactttagggtcttcctcatgtaatatttatatttttccctttttctgtatatccttttttttctctctgaaaaacgtaacactgtcagccagaggaagtaatatattctagggaatgggaaactcatgcttcctgtgagtctttaaactgtccattgtccatcttggcaacatgaagaaaccccgtctctacaaaaagtacaaaaatcagccaggtgtggtggcacacggctatagccccagcttctcgggtggctgaggtgggaggatcacctgagcccagggggtcaaggttgcagtgagctgtgatcgtgtccctgtactctaccctgggtaacagagtgagacctatctcaaaaaaa

SEQ ID NO: 377110 - DNA, 652 bp, Homo sapiens
tgctaaaattaatgtgggggagacacaaaggatcccaaatagccaaacaatcttgaccaaaaagagcaaagctggagacatcacactactgtattgcaaaatttattacaaagctatagcaatcaaaaaagcatgatgctggcataaaaacagacaagtctaccaatgaaataggacagagagcccagaaataaacccatgcatctacagtcaattgctttttgacaggaacacacattgaggaaaggacaatctgttcaaaaggtggtattgggaaaactggatatccacatatagaagaatgaaagtggatctttatttcacccctcatatgagaatcaactcaaaatggaataaagacttgaaactatgaaactgaaactataaaactgctagaggtctggacagagatttctttgatatgaacccaaaagcataagcaataaaagcaaaaatagacaaatggaattgcattaaagtgaaaagctactgcatagaaaaggaaacaatgaaggaaagagacaacacacagattgggagaaaatatttgcaaatgatacactggagaagggactaatatccgaaatatactaggaactcaaactactcagcaacaagaaaacagccctgttaaaaataagcaaaggacttg

SEQ ID NO: 377111 - DNA, 476 bp, Homo sapiens
aacaagctgcccgatgctgatattgcaggtcagtggaccacacttttgagtaaggtctagggtcttagcctttatgcgagagtctcagtttcatttcttaaggcccttctgcccctgcatatgtattaaaacccaagttggttttaatacatgggtaacacagcatgttacccatattaatcagtgcactctcagctctgtcctccagattcttcatttctggtacgtgaggcatttcctacctaccttttcagcttagcttgatgtgtgtgtttgttggggaggggagtgggtatacgtgtgcacttatcacatattttatccattatatatagtaataagacttttaagttgtcttcacatacttctctgaatagtttggtcccaccaataaacctatcactgttcaactggaagtttcctgtaaatctatttatagaccttttgggaaaatgccattaaataaataccacatt

SEQ ID NO: 377112 - DNA, 468 bp, Homo sapiens
acacacacacacacacacacacacacacacatatacatacacacatgcacacatgtacacacatgcatcatacatatgcacatatacataacaaacacatacacacacatacagtcatgcctacttaactacaaggatatgttccaagaaatgcatcattatgtaatttcattgctatgcaagcatcacagagtatacttacacaaagtcacatggtgtagcctactatacacctaggctgtatggtgtagtctattggtcctatgcaacaaaccagtacagcatgtgaccactgcataccataggcagttgtaacacaatggtaagtattggtgtatctaaacatacctacatagaaaatgcacagtacaaatgtggtattataatcttatgggacaaccatcatatagatgatttctgattgaccaaaacagtattatgcagcatatgacagtacatacacacaca

SEQ ID NO: 377113 - DNA, 1444 bp, Homo sapiens
atcaaggtgatcccaaaacgaaccaacagaccaggcatcagcacaacagaccggggttttccacgagcccgctaccgcgcccggaccaccaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377114 - DNA, 1426 bp, Homo sapiens
  misc_feature (1)..(1): n is a, c, g, or t
  misc_feature (4)..(4): n is a, c, g, or t
  misc_feature (6)..(6): n is a, c, g, or t
nacnanggagtccgggaggggtcgctttgctcctccggaaggcttccccttcagccaatcaccgttcgaggcccgcccccgtcgccggaaggagccgtcgccccgagcaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377115 - DNA, 988 bp, Homo sapiens
ggtagtagcttagatgagttctgtctgtgcttgatggaaatggcatcgtacgcatctgcttttacctatatagtgttttgcacacgtgttcacaaatctgtgtggcctgtactctgacggaaaataccaaaccaatgataattaagtcatgaggcagttggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377116 - DNA, 1473 bp, Homo sapiens
cggtacccggtgtttatcgatgccacccaactacaacgtccggctttctgagttgggtggcgggaaaggcgatgagtaaaggccgggcagaagctgcggcgggaggtaacggcgccgtgggcgcggggaagacccgggagggcagtgggtgaggaggtcggttgagtggccccctcccctgcctttctctccgtagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377117 - DNA, 1361 bp, Homo sapiens
cggtacccggtgtttatcgatgccacccaactacaacgtccggctttctgagttgggtggcgggaaaggcgatgagtaaaggccgggcagaagctgcggcgggaggtaacggcgccgtgggcgcggggaagacccgggagggcagtgggtgaggaggtcggttgagtggccccctcccctgcctttctctccgtagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcagagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377118 - DNA, 2057 bp, Homo sapiens
actgcactggctggcatactttttcaacctgctccccatcaccaactgatgtgacctcccccacccccacactgatccccagtgcagttcttttctagcaatggcccctcatgagagaagctcctcagacttactggaatcccttatctacatggatcccaagacccagcatagtggctcatgcatgtaatcccagcactttgggaggctgaggcggatggatcacttgagcccaggagtttgagaccagcctgggcaacgtggtgaaaccccttctctactaaaaatacaaaaattagctgcgcttggtggtgcgcgcctgtaatcccagctacttaggaggctgaggcatgagaatcgcttgaagccaggaggcggaggttgcagtcagccaagattgcaccactgcactctggcctgggtgacagagaaagaaagagaggaaaagagggaagggagggagaaagagggagggagggaggaaaaaggaaggaaggaaggagggagagaggaaggtggaaagaaggatgggaagaaaggacaggaaggaagaagaaaagaagtccatccatcccatccatcatgcttcttcacctgtccagtttctatctattatggaaacccatgatctaggtttccccaccgtgggaacaatgttacttaactgcttcagcccaggtagtggttttatcactaaatgggaagatttctgtcctaatcagtatcctgtcaacctagtagcttaaggacaagcattagatttcagcttttctttcctacctttttagtggggccgctccttaactgaaaacaatttctcaaaagtactctcccactatttctgcagaccctctggagactttggggtgtggctggttcctgagcatatccaaatggtgccttcccaggtgtgtgttcccatctttgtgcctcacaacagttcacttgtattttccctctttgtctggcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377119 - DNA, 1283 bp, Homo sapiens
actgcactggctggcatactttttcaacctgctccccatcaccaactgatgtgacctcccccacccccacactgatccccagtgcagttcttttctagcaatggcccctcatgagagaagctcctcagacttactggaatcccttatctacatggatcccaagacccagcatagtggctcatgcatgtaatcccagcactttgggaggctgaggcggatggatcacttgagcccaggagtttgagaccagcctgggcaacgtggtgaaaccccttctctactaaaaatacaaaaattagctgcgcttggtggtgcgcgcctgtaatcccagctacttaggaggctgaggcatgagaatcgcttgaagccaggaggcggaggttgcagtcagccaagattgcaccactgcactctggcctgggtgacagagaaagaaagagaggaaaagagggaagggagggagaaagagggagggagggaggaaaaaggaaggaaggaaggagggagagaggaaggtggaaagaaggatgggaagaaaggacaggaaggaagaagaaaagaagtccatccatcccatccatcatgcttcttcacctgtccagtttctatctattatggaaacccatgatctaggtttccccaccgtgggaacaatgttacttaactgcttcagcccaggtagtggttttatcactaaatgggaagatttctgtcctaatcagtatcctgtcaacctagtagcttaaggacaagcattagatttcagcttttctttcctacctttttagtggggccgctccttaactgaaaacaatttctcaaaagtactctcccactatttctgcagaccctctggagactttggggtgtggctggttcctgagcatatccaaatggtgccttcccaggtgtgtgttcccatctttgtgcctcacaacagttcacttgtattttccctctttgtctggcaggaccagtttgacatggtgagtgatgctgaccttcaagtcctagatggcaaaatcgtggccctcactgctaaggtgcagagcttgcagcagagctgccgctacatggaggctggtaggactgggtagcccctccaaagtgcccataggcttaggttcattctagaggtcaggaattactaaatgaatggttcaatgactgcagcatcttgttgcagctaagacccctttgctgggctcccttaggcataaaaagaaatgtaggataactaacggcttttgtgtaccaacaaatggacaagatacgcatttgtt

SEQ ID NO: 377120 - DNA, 887 bp, Homo sapiens
cggtacccggtgtttatcgatgccacccaactacaacgtccggctttctgagttgggtggcgggaaaggcgatgagtaaaggccgggcagaagctgcggcgggaggtaacggcgccgtgggcgcggggaagacccgggagggcagtgggtgaggaggtcggttgagtggccccctcccctgcctttctctccgtagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggtgaggagaacttgcgccgattgtcacccatgagagcccgacaacgggtgaatctactcctggtgtgaactctttggggacaaggccccccatggaaaactcacctgtcttaggccaccatccttaaatcaaggtgtgtactcctcttgttaggatcccaacttcacgaggtttccagatttacaatatgatggatgacagaagattctgtattgttgctaccaagatccatttccgctccaaagctcttattccttatcatctacattagcaacaccctctgccaaatgatgttcctcctgcctccatccgattctctaaacacacatatcaaatttatattctccagcccagacctccagctggaatctgtcaggcattaatatcagagtcaaaattgccacagtagaatgcctcatcttccccccaccccggactggtttctttctaacattctcctcccctaatggaattactcttcacccaaaccagaaattggg

SEQ ID NO: 377121 - DNA, 482 bp, Homo sapiens
cggtacccggtgtttatcgatgccacccaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggtgaggagaacttgcgccgattgtcacccatgagagcccgacaacgggtgaatctactcctggtgtgaactctttggggacaaggccccccatggaaaactcacctgtcttaggccaccatccttaaatcaagacctggagatctccaggtccacagctgactagggccagcgcaaatactggaac

SEQ ID NO: 377122 - DNA, 1382 bp, Homo sapiens
cggtacccggtgtttatcgatgccacccaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377123 - DNA, 1400 bp, Homo sapiens
cggtacccggtgtttatcgatgccacccaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcagtccctctttgtctggcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377124 - DNA, 1677 bp, Homo sapiens
  misc_feature (5)..(5): n is a, c, g, or t
gaganatactgtctttccctctctttctttctctggcctgggtgacagagaaagaaagagaggaaaagagggaagggagggagaaagagggagggagggaggaaaaaggaaggaaggaaggagggagagaggaaggtggaaagaaggatgggaagaaaggacaggaaggaagaagaaaagaagtccatccatcccatccatcatgcttcttcacctgtccagtttctatctattatggaaacccatgatctaggtttccccaccgtgggaacaatgttacttaactgcttcagcccaggtagtggttttatcactaaatgggaagatttctgtcctaatcagtatcctgtcaacctagtagcttaaggacaagcattagatttcagcttttctttcctacctttttagtggggccgctccttaactgaaaacaatttctcaaaagtactctcccactatttctgcagaccctctggagactttggggtgtggctggttcctgagcatatccaaatggtgccttcccaggtgtgtgttcccatctttgtgcctcacaacagttcacttgtattttccctctttgtctggcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgt

SEQ ID NO: 377125 - DNA, 434 bp, Homo sapiens
gaaacatttttatacatgattcctggtgcacatataaacacatatttctgtaggatatatatctaggagtggaaatgtggagtcttaatggtgttccaactttactaaataatgtattccaaggtggttatacacattctcaccaggagtaaatgagagttattaccccaatcttttccagtatttagtattttcatacttttgaattttagctagcttggtacatgttacggactaaatgtttgtgtccccccaccagattcatatgttgaaatcttttttttttttttttttgagacggagtctcgctctgtcgcccaggctggagttcagtggcgggatctcggctcactgcaagctccgcctcccgggttcacgccattctcctgcctcagcctcccaagtagctgggactacaggcgcccgccactacg

SEQ ID NO: 377126 - DNA, 318 bp, Homo sapiens
aaaaaaaaaaaaaaaaaaaaaaaaagctgagatttactgagcacatgacatgtgcaaaacacttctaaatgccccacatgttatttaacccccaagagccattgaattactatagttcttgttactgtcttcattttactggtgagggaactgaagcacagaacgatcaagtaacctctccaaggtcacacagctagaaagtggtggaccccagagctcatgccgcagccgcctcccacccaagagttggaactatcctaggaaacaatcaaaacttgtctcaactggcagagcacaccatcctttttcctttaattt

SEQ ID NO: 377127 - DNA, 4193 bp, Homo sapiens
tgtttttggcagcttggttttggggggaccctaaaaaaggccttcggggtttcttttatcggggggagggggcggtggtcccgacttggccagccgcctgttgaagcgggggagcggggagcaggggcatgcgaacccggctccccccaccatgatgaagacggagccacgggggcccgggggtcccctccggagcgcctccccgcaccgcagcgcctacgaggcgggcatccaggcgctgaagccgcccgacgcgcccgggcccgacgaggcacccaagggggcccaccacaagaaatatggctccaacgtccaccgcatcaaaagtatgttcctgcagatgggcacgacggcggggccctcgggcgaggcgggcggcggcgcgggcctggccgaggccccacgggcgtccgagcgcggcgtgcgcctgtcgctgccgcgggccagcagcctgaacgagaacgtggaccacagcgccctgctgaagctgggcaccagcgtgtcggagcgcgtgagccgcttcgactccaagcccgcgccctccgcgcagcctgcgccgccgccgcacccgccgtcccggctgcaggagacgcggaagctgttcgaacggagcgccccagcggcaggcggcgacaaggaggcggcgcggcggctgctgaggcaggagcgcgccggcctgcaggaccggaagctggacgtcgtggtgcgcttcaacggcagcaccgaggcgctggacaagctggacgctgacgccgtgtcccccacggtcagccagctcagcgccgtcttcgagaaggccgactcgaggaccggcctccaccgcgggcccgggctccccagggccgcaggggttccccaggtcaactcgaagctggtcagcaagcggtcccgggtgttccagcccccgccgccgccgccgcccgccccgtcgggggatgccccggccgagaaagagcgatgccccgcagggcagcagcccccgcagcaccgagtggcccctgcccggccgccccccaagccccgggaggtgcgcaagattaagccggtggaggtggaggagagcggggagtcggaggccgagtcggcgcccggggaggtgatccaggccgaggttacggtccacgcggccctggagaatggcagcaccgtggcaactgcagccagccccgcgcccgaggagccaaaggcccaagcggccccggagaaggaggcggcggcggtagcgccgccagagaggggggtgggcaatggccgggccccggacgtggcccctgaggaggtagatgaatccaagaaggaggacttctcggaggcggacttggtggacgtgagcgcctacagtgggctcggggaggactctgcgggcagtgccctggaggaggacgacgaagacgacgaggaggatggggagcccccctacgagcccgagtcggggtgcgtggagatcccggggctgtcggaggaggaggacccagccccgagccggaagatccatttcagcacggcgcccatccaagtgttcagcacttactccaacgaggattacgatcgtcgcaacgaggatgtggatcccatggcagcctctgctgagtacgagctggagaagcgtgtggagaggttggagctgttccctgtggagctggagaaggactccgagggcctgggcatcagcatcatcggcatgggcgccggggcagacatgggcctggagaagctgggtatcttcgtcaagaccgtgacggagggtggtgcggcccatcgggatggcaggatccaggtgaatgatctcctggtggaggtggatggaacaagtctggtgggagtgacccagagcttcgcggcgtctgtgctccggaacaccaagggccgagtgcggtttatgattggccgggagcggccgggagagcagagcgaagtggcccagctaattcagcagactttggaacaggagcgatggcagcgggagatgatggagcagagatacgcccagtatggggaggatgacgaggagacgggagagtatgccactgacgaggatgaggagctgagccccacgttcccgggtggtgagatggccatcgaggtgtttgagctagcggagaacgaggatgcactgtcccctgtggacatggagcccgagaagctggtgcacaagttcaaggagctccagatcaagcatgcggtcactgaggcagagatccagcagctgaaaagaaagctgcagagcctggagcaggagaaggggcgctggcgggtggagaaggcgcagttggagcagagtgtggaggagaacaaggagcgcatggagaaactggaaggctactggggtgaggcccagagcctgtgccaggctgtggacgagcacctgcgggagactcaggcgcagtaccaggccctggagcgcaagtacagcaaggccaagcgcctcatcaaggactaccagcagaaggagatcgagttcctgaaaaaggagactgcacagcgtcgggttctggaggagtcggagctggccagaaaggaggagatggacaagctcctggacaagatctcagaactggaaggaaacttgcaaacactgaggaattccaattctacttaacaggaatcattccatgactggacaataattaacccccctcccattgtcctccctcccctgtcctcaacaccccacccctcccccttccagcctggggacaggtgccccgactccccccacccctccaccccacctcccccagcttcagggaccagagggctcatatcacaggcccccttaagatggcctgggcagacagaggtggctagaagggcagcctctttcttgccccatggggctgaggcacagaggccgagggctgccgagggctggcctggtggtcgacggacacaagcacctgcagatcaaactgccagactttacacactccagcttttgtctctggactggaacggggctggggctctcccagcatctgccaactgggggctgctccctgcccatggggcacctgggtggcccctgggcctcttgacttgagattctaccttctcggcccttccctctccccccatcattgtgccgtctctgttgcattctgaccctcccgcctggggggtgggggcgttgcctcaacacctcccccatccctgttccctgtcctgggagggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgcctggaagcctactgacattgcagggagtcagcctcgcccccaccccctactggttttccaatgttttgactggagggcaaaattttactactactcatctttttggagaccagggctgccctgctggcagcctgccttctaagtgaaatcgactctgtttccccactttaaccccaaattggggcttggaccaagggaggtgagaccacctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctatccccagatgtgcccccatcccctgaaggagctggctgtctcagtcctgggctcgcgcacttcaccccggcagatggagggggcggaaccgggtgggcggggccgcttcgggctgcttgggccagcggccacccctgcccagccgtcgggagggccgcatctctgtatataatatatatatgtatgtattgttcccggttttgtacggaccatgccctctgtcaggtcgtccccataaaagcagcccccaga

SEQ ID NO: 377128 - DNA, 2509 bp, Homo sapiens
tgtttttggcagcttggttttggggggaccctaaaaaaggccttcggggtttcttttatcggggggagggggcggtggtcccgacttggccagccgcctgttgaagcgggggagcggggagcaggggcatgcgaacccggctccccccaccatgatgaagacggagccacgggggcccgggggtcccctccggagcgcctccccgcaccgcagcgcctacgaggcgggcatccaggcgctgaagccgcccgacgcgcccgggcccgacgaggcacccaagggggcccaccacaagaaatatggctccaacgtccaccgcatcaaaagtatgttcctgcagatgggcacgacggcggggccctcgggcgaggcgggcggcggcgcgggcctggccgaggccccacgggcgtccgagcgcggcgtgcgcctgtcgctgccgcgggccagcagcctgaacgagaacgtggaccacagcgccctgctgaagctgggcaccagcgtgtcggagcgcgtgagccgcttcgactccaagcccgcgccctccgcgcagcctgcgccgccgccgcacccgccgtcccggctgcaggagacgcggaagctgttcgaacggagcgccccagcggcaggcggcgacaaggaggcggcgcggcggctgctgaggcaggagcgcgccggcctgcaggaccggaagctggacgtcgtggtgcgcttcaacggcagcaccgaggcgctggacaagctggacgctgacgccgtgtcccccacggtcagccagctcagcgccgtcttcgagaaggccgactcgaggaccggcctccaccgcgggcccgggctccccagggccgcaggggttccccaggtcaactcgaagctggtcagcaagcggtcccgggtgttccagcccccgccgccgccgccgcccgccccgtcgggggatgccccggccgagaaagagcgatgccccgcagggcagcagcccccgcagcaccgagtggccccttccagcctggggacaggtgccccgactccccccacccctccaccccacctcccccagcttcagggaccagagggctcatatcacaggcccccttaagatggcctgggcagacagaggtggctagaagggcagcctctttcttgccccatggggctgaggcacagaggccgagggctgccgagggctggcctggtggtcgacggacacaagcacctgcagatcaaactgccagactttacacactccagcttttgtctctggactggaacggggctggggctctcccagcatctgccaactgggggctgctccctgcccatggggcacctgggtggcccctgggcctcttgacttgagattctaccttctcggcccttccctctccccccatcattgtgccgtctctgttgcattctgaccctcccgcctggggggtgggggcgttgcctcaacacctcccccatccctgttccctgtcctgggagggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgcctggaagcctactgacattgcagggagtcagcctcgcccccaccccctactggttttccaatgttttgactggagggcaaaattttactactactcatctttttggagaccagggctgccctgctggcagcctgccttctaagtgaaatcgactctgtttccccactttaaccccaaattggggcttggaccaagggaggtgagaccacctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctatccccagatgtgcccccatcccctgaaggagctggctgtctcagtcctgggctcgcgcacttcaccccggcagatggagggggcggaaccgggtgggcggggccgcttcgggctgcttgggccagcggccacccctgcccagccgtcgggagggccgcatctctgtatataatatatatatgtatgtattgttcccggttttgtacggaccatgccctctgtcaggtcgtccccataaaagcagcccccaga

SEQ ID NO: 377129 - DNA, 2143 bp, Homo sapiens
gtcccctgctgtcatcatatacgtccgcgagaagcctggtagcacaagtatcaacggcagctcgatgcatcaatgctattgctggtcgattgacgtgctcgacgatccagtcaagactcgatgaatgaaacgctgcagcatgtcacatgtaatacttggacgaatggtggctcgtggctggtgatgagaagaagcgccgtcgcgttggacgcatcactctgttgcatcgacgtacatcaaagtgacgctgcaatggagaaactggaaggctactggggtgaggcccagagcctgtgccaggctgtggacgagcacctgcgggagactcaggcgcagtaccaggccctggagcgcaagtacagcaaggccaagcgcctcatcaaggactaccagcagaaggagatcgagttcctgaaaaaggagactgcacagcgtcgggttctggaggagtcggagctggccagaaaggaggagatggacaagctcctggacaagatctcagaactggaaggaaacttgcaaacactgaggaattccaattctacttaacaggaatcattccatgactggacaataattaacccccctcccattgtcctccctcccctgtcctcaacaccccacccctcccccttccagcctggggacaggtgccccgactccccccacccctccaccccacctcccccagcttcagggaccagagggctcatatcacaggcccccttaagatggcctgggcagacagaggtggctagaagggcagcctctttcttgccccatggggctgaggcacagaggccgagggctgccgagggctggcctggtggtcgacggacacaagcacctgcagatcaaactgccagactttacacactccagcttttgtctctggactggaacggggctggggctctcccagcatctgccaactgggggctgctccctgcccatggggcacctgggtggcccctgggcctcttgacttgagattctaccttctcggcccttccctctccccccatcattgtgccgtctctgttgcattctgaccctcccgcctggggggtgggggcgttgcctcaacacctcccccatccctgttccctgtcctgggagggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgcctggaagcctactgacattgcagggagtcagcctcgcccccaccccctactggttttccaatgttttgactggagggcaaaattttactactactcatctttttggagaccagggctgccctgctggcagcctgccttctaagtgaaatcgactctgtttccccactttaaccccaaattggggcttggaccaagggaggtgagaccacctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctatccccagatgtgcccccatcccctgaaggagctggctgtctcagtcctgggctcgcgcacttcaccccggcagatggagggggcggaaccgggtgggcggggccgcttcgggctgcttgggccagcggccacccctgcccagccgtcgggagggccgcatctctgtatataatatatatatgtatgtattgttcccggttttgtacggaccatgccctctgtcaggtcgtccccataaaagcagcccccaga

SEQ ID NO: 377130 - DNA, 2686 bp, Homo sapiens
  misc_feature (2686)..(2686): n is a, c, g, or t
tgtttttggcagcttggttttggggggaccctaaaaaaggccttcggggtttcttttatcggggggagggggcggtggtcccgacttggccagccgcctgttgaagcgggggagcggggagcaggggcatgcgaacccggctccccccaccatgatgaagacggagccacgggggcccgggggtcccctccggagcgcctccccgcaccgcagcgcctacgaggcgggcatccaggcgctgaagccgcccgacgcgcccgggcccgacgaggcacccaagggggcccaccacaagaaatatggctccaacgtccaccgcatcaaaagtatgttcctgcagatgggcacgacggcggggccctcgggcgaggcgggcggcggcgcgggcctggccgaggccccacgggcgtccgagcgcggcgtgcgcctgtcgctgccgcgggccagcagcctgaacgagaacgtggaccacagcgccctgctgaagctgggcaccagcgtgtcggagcgcgtgagccgcttcgactccaagcccgcgccctccgcgcagcctgcgccgccgccgcacccgccgtcccggctgcaggagacgcggaagctgttcgaacggagcgccccagcggcaggcggcgacaaggaggcggcgcggcggctgctgaggcaggagcgcgccggcctgcaggaccggaagctggacgtcgtggtgcgcttcaacggcagcaccgaggcgctggacaagctggacgctgacgccgtgtcccccacggtcagccagctcagcgccgtcttcgagaaggccgactcgaggaccggcctccaccgcgggcccgggctccccagggccgcaggggttccccaggtcaactcgaagctggtcagcaagcggtcccgggtgttccagcccccgccgccgccgccgcccgccccgtcgggggatgccccggccgagaaagagcgatgccccgcagggcagcagcccccgcagcaccgagtggcccctgcccggccgccccccaagccccgggaggtgcgcaagattaagccggtggaggtggaggagagcggggagtcggaggccgagtcggcgcccggggaggtgatccaggccgaggttacggtccacgcggccctggagaatggcagcaccgtggcaactgcagccagccccgcgcccgaggagccaaaggcccaagcggccccggagaaggaggcggcggcggtagcgccgccagagaggggggtgggcaatggccgggccccggacgtggcccctgaggaggtagatgaatccaagaaggaggacttctcggaggcggacttggtggacgtgagcgcctacagtgggctcggggaggactctgcgggcagtgccctggaggaggacgacgaagacgacgaggaggatggggagcccccctacgagcccgagtcggggtgcgtggagatcccggggctgtcggaggaggaggacccagccccgagccggaagatccatttcagcacggcgcccatccaagtgttcagcacttactccaacgaggattacgatcgtcgcaacgaggatgtggatcccatggcagcctctgctgagtacgagctggagaagcgtgtggagaggttggagctgttccctgtggagctggagaaggactccgagggcctgggcatcagcatcatcggcatgggcgccggggcagacatgggcctggagaagctgggtatcttcgtcaagaccgtgacggagggtggtgcggcccatcgggatggcaggatccaggtgaatgatctcctggtggaggtggatggaacaagtctggtgggagtgacccagagcttcgcggcgtctgtgctccggaacaccaagggccgagtgcggtttatgattggccgggagcggccgggagagcagagcgaagtggcccagctaattcagcagactttggaacaggagcgatggcagcgggagatgatggagcagagatacgcccagtatggggaggatgacgaggagacgggagagtatgccactgacgaggatgaggagctgagccccacgttcccgggtggtgagatggccatcgaggtgtttgagctagcggagaacgaggatgcactgtcccctgtggacatggagcccgagaagctggtgcacaagttcaaggagctccagatcaagcatgcggtcactgaggcagagatccagcagctgaaaagaaagctgcagagcctggagcaggagaaggggcgctggcgggtggagaaggcgcagttggagcagagtgtggaggagaacaaggagcgcatggagaaactggaaggctactggggtgaggcccagagcctgtgccaggctgtggacgagcacctgcgggagactcaggcgcagtaccaggccctggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttcctttgttccctcccatgcctagctggattgcagagttaagtttatgattatgaaataaaactaaataacaaaaaaaaaatn

SEQ ID NO: 377131 - DNA, 4324 bp, Homo sapiens
tgtttttggcagcttggttttggggggaccctaaaaaaggccttcggggtttcttttatcggggggagggggcggtggtcccgacttggccagccgcctgttgaagcgggggagcggggagcaggggcatgcgaacccggctccccccaccatgatgaagacggagccacgggggcccgggggtcccctccggagcgcctccccgcaccgcagcgcctacgaggcgggcatccaggcgctgaagccgcccgacgcgcccgggcccgacgaggcacccaagggggcccaccacaagaaatatggctccaacgtccaccgcatcaaaagtatgttcctgcagatgggcacgacggcggggccctcgggcgaggcgggcggcggcgcgggcctggccgaggccccacgggcgtccgagcgcggcgtgcgcctgtcgctgccgcgggccagcagcctgaacgagaacgtggaccacagcgccctgctgaagctgggcaccagcgtgtcggagcgcgtgagccgcttcgactccaagcccgcgccctccgcgcagcctgcgccgccgccgcacccgccgtcccggctgcaggagacgcggaagctgttcgaacggagcgccccagcggcaggcggcgacaaggaggcggcgcggcggctgctgaggcaggagcgcgccggcctgcaggaccggaagctggacgtcgtggtgcgcttcaacggcagcaccgaggcgctggacaagctggacgctgacgccgtgtcccccacggtcagccagctcagcgccgtcttcgagaaggccgactcgaggaccggcctccaccgcgggcccgggctccccagggccgcaggggttccccaggtcaactcgaagctggtcagcaagcggtcccgggtgttccagcccccgccgccgccgccgcccgccccgtcgggggatgccccggccgagaaagagcgatgccccgcagggcagcagcccccgcagcaccgagtggcccctgcccggccgccccccaagccccgggaggtgcgcaagattaagccggtggaggtggaggagagcggggagtcggaggccgagtcggcgcccggggaggtgatccaggccgaggttacggtccacgcggccctggagaatggcagcaccgtggcaactgcagccagccccgcgcccgaggagccaaaggcccaagcggccccggagaaggaggcggcggcggtagcgccgccagagaggggggtgggcaatggccgggccccggacgtggcccctgaggaggtagatgaatccaagaaggaggacttctcggaggcggacttggtggacgtgagcgcctacagtgggctcggggaggactctgcgggcagtgccctggaggaggacgacgaagacgacgaggaggatggggagcccccctacgagcccgagtcggggtgcgtggagatcccggggctgtcggaggaggaggacccagccccgagccggaagatccatttcagcacggcgcccatccaagtgttcagcacttactccaacgaggattacgatcgtcgcaacgaggatgtggatcccatggcagcctctgctgagtacgagctggagaagcgtgtggagaggttggagctgttccctgtggagctggagaaggactccgagggcctgggcatcagcatcatcggcatgggcgccggggcagacatgggcctggagaagctgggtatcttcgtcaagaccgtgacggagggtggtgcggcccatcgggatggcaggatccaggtgaatgatctcctggtggaggtggatggaacaagtctggtgggagtgacccagagcttcgcggcgtctgtgctccggaacaccaagggccgagtgcgccttcggactcagccctctcatctctcctcccctgggagggcctgagtttggagaggggagcatcagcagggaggatgatgcattacctggctgaggacagaggcagcggatgatgccggtgcccctgcaggtttatgattggccgggagcggccgggagagcagagcgaagtggcccagctaattcagcagactttggaacaggagcgatggcagcgggagatgatggagcagagatacgcccagtatggggaggatgacgaggagacgggagagtatgccactgacgaggatgaggagctgagccccacgttcccgggtggtgagatggccatcgaggtgtttgagctagcggagaacgaggatgcactgtcccctgtggacatggagcccgagaagctggtgcacaagttcaaggagctccagatcaagcatgcggtcactgaggcagagatccagcagctgaaaagaaagctgcagagcctggagcaggagaaggggcgctggcgggtggagaaggcgcagttggagcagagtgtggaggagaacaaggagcgcatggagaaactggaaggctactggggtgaggcccagagcctgtgccaggctgtggacgagcacctgcgggagactcaggcgcagtaccaggccctggagcgcaagtacagcaaggccaagcgcctcatcaaggactaccagcagaaggagatcgagttcctgaaaaaggagactgcacagcgtcgggttctggaggagtcggagctggccagaaaggaggagatggacaagctcctggacaagatctcagaactggaaggaaacttgcaaacactgaggaattccaattctacttaacaggaatcattccatgactggacaataattaacccccctcccattgtcctccctcccctgtcctcaacaccccacccctcccccttccagcctggggacaggtgccccgactccccccacccctccaccccacctcccccagcttcagggaccagagggctcatatcacaggcccccttaagatggcctgggcagacagaggtggctagaagggcagcctctttcttgccccatggggctgaggcacagaggccgagggctgccgagggctggcctggtggtcgacggacacaagcacctgcagatcaaactgccagactttacacactccagcttttgtctctggactggaacggggctggggctctcccagcatctgccaactgggggctgctccctgcccatggggcacctgggtggcccctgggcctcttgacttgagattctaccttctcggcccttccctctccccccatcattgtgccgtctctgttgcattctgaccctcccgcctggggggtgggggcgttgcctcaacacctcccccatccctgttccctgtcctgggagggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgcctggaagcctactgacattgcagggagtcagcctcgcccccaccccctactggttttccaatgttttgactggagggcaaaattttactactactcatctttttggagaccagggctgccctgctggcagcctgccttctaagtgaaatcgactctgtttccccactttaaccccaaattggggcttggaccaagggaggtgagaccacctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctatccccagatgtgcccccatcccctgaaggagctggctgtctcagtcctgggctcgcgcacttcaccccggcagatggagggggcggaaccgggtgggcggggccgcttcgggctgcttgggccagcggccacccctgcccagccgtcgggagggccgcatctctgtatataatatatatatgtatgtattgttcccggttttgtacggaccatgccctctgtcaggtcgtccccataaaagcagcccccaga

SEQ ID NO: 377132 - DNA, 2253 bp, Homo sapiens
gggtgtctaatcagtcacgagggtgagtgggtgtcagagatacgcccaggggggggagtgatgacgaggagacgggagagtatgccactgacgaggatgaggagctgagccccacgttcccgggtggtgagatggccatcgaggtgtttgagctagcggagaacgaggatgcactgtcccctgtggacatggagcccgagaagctggtgcacaagttcaaggagctccagatcaagcatgcggtcactgaggcagagatccagcagctgaaaagaaagctgcagagcctggagcaggagaaggggcgctggcgggtggagaaggcgcagttggagcagagtgtggaggagaacaaggagcgcatggagaaactggaaggctactggggtgaggcccagagcctgtgccaggctgtggacgagcacctgcgggagactcaggcgcagtaccaggccctggagcgcaagtacagcaaggccaagcgcctcatcaaggactaccagcagaaggagatcgagttcctgaaaaaggagactgcacagcgtcgggttctggaggagtcggagctggccagaaaggaggagatggacaagctcctggacaagatctcagaactggaaggaaacttgcaaacactgaggaattccaattctacttaacaggaatcattccatgactggacaataattaacccccctcccattgtcctccctcccctgtcctcaacaccccacccctcccccttccagcctggggacaggtgccccgactccccccacccctccaccccacctcccccagcttcagggaccagagggctcatatcacaggcccccttaagatggcctgggcagacagaggtggctagaagggcagcctctttcttgccccatggggctgaggcacagaggccgagggctgccgagggctggcctggtggtcgacggacacaagcacctgcagatcaaactgccagactttacacactccagcttttgtctctggactggaacggggctggggctctcccagcatctgccaactgggggctgctccctgcccatggggcacctgggtggcccctgggcctcttgacttgagattctaccttctcggcccttccctctccccccatcattgtgccgtctctgttgcattctgaccctcccgcctggggggtgggggcgttgcctcaacacctcccccatccctgttccctgtcctgggagggatagagtccaccccagagcccggaggctgggcctggccctggccctgcactgatttctcatgtgtccttcgggaaaagggggagtgagagtgggaaaaagggagagttcaggacacctggtccccagctccccattgcctggggcagcagccctcaatttctccttgtgcctcccctcttccaggtgccaaatagccataacctcgtcttggaactgttatgtggcctctctggggtccaggtttcctggtcaagcctgggaatgccagggaggaaagggggtctggctacagcgaccctggtcttaggcaaggggaacatttctccctggagagtcaggtcctatcctgtgctgccctgtctgcccagcccagggcgatgcctggaagcctactgacattgcagggagtcagcctcgcccccaccccctactggttttccaatgttttgactggagggcaaaattttactactactcatctttttggagaccagggctgccctgctggcagcctgccttctaagtgaaatcgactctgtttccccactttaaccccaaattggggcttggaccaagggaggtgagaccacctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctatccccagatgtgcccccatcccctgaaggagctggctgtctcagtcctgggctcgcgcacttcaccccggcagatggagggggcggaaccgggtgggcggggccgcttcgggctgcttgggccagcggccacccctgcccagccgtcgggagggccgcatctctgtatataatatatatatgtatgtattgttcccggttttgtacggaccatgccctctgtcaggtcgtccccataaaagcagcccccaga

SEQ ID NO: 377133 - DNA, 2936 bp, Homo sapiens
tgtttttggcagcttggttttggggggaccctaaaaaaggccttcggggtttcttttatcggggggagggggcggtggtcccgacttggccagccgcctgttgaagcgggggagcggggagcaggggcatgcgaacccggctccccccaccatgatgaagacggagccacgggggcccgggggtcccctccggagcgcctccccgcaccgcagcgcctacgaggcgggcatccaggcgctgaagccgcccgacgcgcccgggcccgacgaggcacccaagggggcccaccacaagaaatatggctccaacgtccaccgcatcaaaagtatgttcctgcagatgggcacgacggcggggccctcgggcgaggcgggcggcggcgcgggcctggccgaggccccacgggcgtccgagcgcggcgtgcgcctgtcgctgccgcgggccagcagcctgaacgagaacgtggaccacagcgccctgctgaagctgggcaccagcgtgtcggagcgcgtgagccgcttcgactccaagcccgcgccctccgcgcagcctgcgccgccgccgcacccgccgtcccggctgcaggagacgcggaagctgttcgaacggagcgccccagcggcaggcggcgacaaggaggcggcgcggcggctgctgaggcaggagcgcgccggcctgcaggaccggaagctggacgtcgtggtgcgcttcaacggcagcaccgaggcgctggacaagctggacgctgacgccgtgtcccccacggtcagccagctcagcgccgtcttcgagaaggccgactcgaggaccggcctccaccgcgggcccgggctccccagggccgcaggggttccccaggtcaactcgaagctggtcagcaagcggtcccgggtgttccagcccccgccgccgccgccgcccgccccgtcgggggatgccccggccgagaaagagcgatgccccgcagggcagcagcccccgcagcaccgagtggcccctgcccggccgccccccaagccccgggaggtgcgcaagattaagccggtggaggtggaggagagcggggagtcggaggccgagtcggcgcccggggaggtgatccaggccgaggttacggtccacgcggccctggagaatggcagcaccgtggcaactgcagccagccccgcgcccgaggagccaaaggcccaagcggccccggagaaggaggcggcggcggtagcgccgccagagaggggggtgggcaatggccgggccccggacgtggcccctgaggaggtagatgaatccaagaaggaggacttctcggaggcggacttggtggacgtgagcgcctacagtgggctcggggaggactctgcgggcagtgccctggaggaggacgacgaagacgacgaggaggatggggagcccccctacgagcccgagtcggggtgcgtggagatcccggggctgtcggaggaggaggacccagccccgagccggaagatccatttcagcacggcgcccatccaagtgttcagcacttactccaacgaggattacgatcgtcgcaacgaggatgtggatcccatggcagcctctgctgagtacgagctggagaagcgtgtggagaggttggagctgttccctgtggagctggagaaggactccgagggcctgggcatcagcatcatcggcatgggcgccggggcagacatgggcctggagaagctgggtatcttcgtcaagaccgtgacggagggtggtgcggcccatcgggatggcaggatccaggtgaatgatctcctggtggaggtggatggaacaagtctggtgggagtgacccagagcttcgcggcgtctgtgctccggaacaccaagggccgagtgcggtttatgattggccgggagcggccgggagagcagagcgaagtggcccagctaattcagcagactttggaacaggagcgatggcagcgggagatgatggagcagagatacgcccagtatggggaggatgacgaggagacgggagagtatgccactgacgaggatgaggagctgagccccacgttcccgggtggtgagatggccatcgaggtgtttgagctagcggagaacgaggatgcactgtcccctgtggacatggagcccgagaagctggtgcacaagttcaaggagctccagatcaagcatgcggtcactgaggcagagatccagcagctgaaaagaaagctgcagagcctggagcaggagaaggggcgctggcgggtggagaaggcgcagttggagcagagtgtggaggagaacaaggagcgcatggagaaactggaaggctactggggtgaggcccagagcctgtgccaggctgtggacgagcacctgcgggagactcaggcgcagtaccaggccctggagcgcaagtacagcaaggccaagcgcctcatcaaggactaccagcagaaggagatcgagttcctgaaaaaggagactgcacagcgtcgggttctggaggagtcggagctggccagaaaggaggagatggacaagctcctggacaagatctcagaactggaaggaaacttgcaaacactgaggaattccaattctacttaacaggaatcattccatgactggacaataattaacccccgcgtcagatggtcctcgctggtgtggtgcatctacagagtagtgggggatgatctcggagagaccaccaggagaggatcgccaaggacgtgcacaggcagagaaagtccgggcaactggctcctggcatcaaacggccaaccagattggcatcgcgatgaccgagtcatcttcaggcgtgcaagcgggaccaggccaacgggtggggcgtcatgggtctcatcgtcgggggagactgaagataccttcatcgctgagctggatgtggggctgggcacgggcagatcaagactggtgcccc

SEQ ID NO: 377134 - DNA, 689 bp, Homo sapiens
cctaaacatgcataccaggatgaagtttaatttataaattaggcacagtaagagatgaacagcaataattaatagtgaaatagaacaattataacaatattctgtaataaattatgttacgtggatgtggtctgtggtctgtctctcctttaaaataccttattgtactatacccactcttcttcttcctgtgatctgtcaacctgataactgagcaacccactaagtgactaatgggaaggtagcatgtacagtgtggatatgctctacgaaggcatgattcgcagcccaaggaggacacagcaggatggcatgagatttcatcacactactcggaacagcctgcaacttaaagcatatgaattgtttacttctggaattttccattgaatatttttggactgtagttgacagcaggtaaccgataccacagaaagtaaaaccaaagataaggggggactactatgcatttcctgatgtaaaacagaaaaaaaaaaattatttcacatttttctagcggtggtctctattttagaaaaaaaaatgcttccagatcataaatgcaaaactcgtgggcatacttttctgtggatatgatggaacgattctcatttgtttttcctaaggttttccaaataatatttccatgaaaacgtatctttttttagtattgaggtatgatttatata

SEQ ID NO: 377135 - DNA, 1107 bp, Homo sapiens
ttagctagactgggttggcatctgtttttcctaagacagccttttctcgtcactgtgaagataaatcaatttaatggacaccactggttgggggtagattgtactttttttgtaagtattgaccacccattagtggcagtgcccagcagcatacaccattgtaccttctccagaaaccctccacttggctgtagatctatccccttccaactctgccctggaagcaagcccaaaatgacctctggagccctaagatgccatcccacggccacgggctttgttctttggctttgtgaaagtgtgctttataaaccttgttggcagactcataattctgctaaggacttatttgttgtgtcaatctacagatcaaaggtgggagcctaaaagcctttgacattgctcataccaaccatattacactctgggatacattgtattaagtactatgggccatcatacaagtaagaaatagttcctgccctccagggacttacaatctagacagcatgaaatgtacaccaataactagcttcactgcttgctggtgatatgacaagacttgctggaagttgtagatgccatatggaagactcagaaggggtgctggatatttgctgaaatcggtggttctcatacttgagcatgcattaaaatcacctagagagctgttaacacagattgctgggtgccactcttagcatttctgattcagtagatctagggtgggcccacaaagttgcattcctaccaagtggccagctgatgcaagtgtggcccaggaataccctgtccaaaatatttttataggagaagcttcttacatatgtaatttccttctgggattgtaacagaactgacatttgttgagtgtctaatatgttctattcagtatattaggtactttggctataatattttctttagattttacaaccctgtgaatttcgtattattactagcactctacaatgagcaaactaaggcttagaaggaggaacttacatttgccagatatccagtatgtaccataaaggatgtggggcattatccaatttaaaactttttgaattctaaatgattagtactcctagtttaggagtggta

SEQ ID NO: 377136 - DNA, 402 bp, Homo sapiens
ccagcccagaagaatagatttgaaagtagtgcagagactggctttcagactcctattatcagccttattggttttcatgttttgccaaatacagcctaagcagtgagagatgtattgagttcctcacaacagaacatgttgaaacataagctacacatttaattggaagaaggcaatatagacaggattcagcctttactgctttgcttttaagctcaaataatagtggtatttggaaaacatcacaaagctctgcagttattttccatagatgttgacttttttttttcctagaagtgattataatattgccagttgatcctgagattacgcatgtgttgaggaaatactaatcagaagtatgtcagtccttcttgcttcacaaagcttctgtatcactaa

SEQ ID NO: 377137 - DNA, 443 bp, Homo sapiens
caggaagactcagaaacatgtcatgcacacgataaaacattttttcttctaatgttgggactttgaagtcccttttggcatgaagagttgtgattccctactcccaggtgttaaatgctgtttacaaatgttatcaggcattttttttcttcgcaaagaggcagaggggcatggctttcttatataggagtgcctgctttgttaaaatactaaaatttaggtttaagatgttaatagaaactccttcaaggtccttcatagtggttcttattgccttccccttacttaccacctagccatagaaggaagaagtaggtggctgggcacagtggctcacatttgtaatcccagcactttgggaggctgaggtggagggaggattgcttgagcccaagagtttgagaccagcctgggcaacatagtgagactcttatctctaaaag

SEQ ID NO: 377138 - DNA, 442 bp, Homo sapiens
  misc_feature (348)..(348): n is a, c, g, or t
  misc_feature (371)..(371): n is a, c, g, or t
  misc_feature (383)..(383): n is a, c, g, or t
  misc_feature (430)..(430): n is a, c, g, or t
gaattaatttttgtaaaagatgtaagatctatgtctagattcatttttttgcctgtggaaatctagttgttctggcaccatttgttgaaaagactgttctttctccattgaaatgtctttgttcctttgtcaaagatcaggtgactatatttatgagggtctgtgttcccttgatctatttgttcttttgctaccagtacaccatcttaattattgaaacttttttttttttttgagacagagtcttgctcagcctgggcgacagagcgagactccgtatcaaaaaaaaaaaatagaaagcatataagcaccagttgtgtctggccagtctgattacggccagcattncagcagctgggaatttgccttcncaagcagtacantggccaggactggtaacaaggggtgagtgcctaggagccagctgganggacagggttct

SEQ ID NO: 377139 - DNA, 221 bp, Homo sapiens
tcccattaagtaacaactgctcattttaccctctctccagccctgacagacaaaccttcaactttctgttttatgatttttgactacttatgatacctcatatagctgggtgtggtggcttacacctgtaatcccatcactttgggaggctgaggcaggcagatcacctgagatcgggagtttgagaccagcctgaccaacatggaaaaaccctgtctgta

SEQ ID NO: 377140 - DNA, 403 bp, Homo sapiens
ttcattacgacaaaaaattaattcacattggaggtttgaggcatcctgaagaattgaggtgcaagctgtgaatgcatctgtcatttttattttgtctgtgtctgacttaattatttcctgttcttgaagattagctgtgatacttgttacagttaagtttcctgatagtagtgtttgctgatattggccgtgcagtgaaaactaggtgcttttgtattgattgggcagacaatggaaaagaagataaaaatattgcggggttaacatcttcaagacatttttatacatttgaacattttccctatctagaataccctgccacgtggaatgagagggtactaaaaataaaaacctatcccattatgcttacgtattgttgagatatttattcatccctggcact

SEQ ID NO: 377141 - DNA, 344 bp, Homo sapiens
ttttttttgccaaatttgggggaatttcaacctttatttcttcattttttaagtctcatcttcgttctcctctccttctggtactccaacaatatgaatatttggattttttgtgagagtcccacagctctctgaggttttgttcagttttttttttcagtctattttctgttgttcagatgggtgatttctattgttctatcttcaagttcattgattctttattctctcatttctgttttgccactgagcccattcactgagtttttaaatttgactactgttatttatttatttttgagatggagtttcgctcttctctcccaggctagagtgcaatggtg

SEQ ID NO: 377142 - DNA, 499 bp, Homo sapiens
ggtggtttagttttctgctttgtggttacaatattgttttttaaatattcaacatgaatacactttcttgtttggataacgtgtaaaacgtctacaaggagggatagataataagttttcccttcagaatgcactgctttgcctgggatgaggaataatttataatggtaactgttgctggttaaaatttggctcctacccacattcatgcaaactcagtgttctagattaaaagagatttaagagacttgccaagcaaatgcatggcatccttagatgtatcctgatttgaataaaacagctataaataataatatttttggggattattgaaaaatttgactataggattagttttcaggtgatattggagaattaatgttattattgttagggtatgttaggcacggtcatgcagcaatgtgtctttctttttaagagatgcatacaaaaatatttgggtgtgaaatgttcttgtgctataatttgctttaaaatt

SEQ ID NO: 377143 - DNA, 358 bp, Homo sapiens
tctgtccattatagatgtaacaagctactcaaaaacaagatccatttctttattattctcccctatatccccaacacctactagaaagtctggctcatagtaagtgctcaataaatgcttgttgaatgaagattaacagatgtacaatcattccatgacatctcaagtataagaaacattgtatgtctttatttttctatatcaaatcaaatcttaatttgccaagattagtgacaattccaatattcgctttttaaatttgcttccatctcctatggatcatactaaaatcccagtaggtaagcagttgaggaaaatggaagtgaaaggtctctgtcccttacatctgcctcttggg

SEQ ID NO: 377144 - DNA, 737 bp, Homo sapiens
tcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccagggacaggacgtgtccaggggaacgctgacacctgtcctcgcgccttctcagtggcccagcgtgatgaaaccagcacgtctccgtggatgtgattgggaacccaggggcagtgccagggggagggcttccctcgaggaggctgtttctaacagatttccccactcaaagatcagatcaccagcagaggagcatcagaaactggctccactgttgggcttttccagagattttgggtccctgcgggttgccctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctct

SEQ ID NO: 377145 - DNA, 390 bp, Homo sapiens
tcacaagtgtgacttcatttgaaatagaaaattgtgatgaagtaagcatacagtcctcatctagagtgacctggagaggctatatgagcttgtttgtaagtagaatcctcttagaacttgtgtagtagaatactcctagttgaaatcttagtcctattacttatcaatcttggaatgttggttaaatttaaggccttgaaacacagcttctttatttgtaaactaaggaaaataataccttcttttatgggttgtaaaaaataagacagtgaggctgaactcatgagagggtctcagtaaatgttccttctcctctgatctgagattccaagtactagaatctgaagccagaggaaatcggtgtttcaactcaatccatgacttcttaaa

SEQ ID NO: 377146 - DNA, 6048 bp, Homo sapiens
cctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttctggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctatatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatttacctcaccaacagcatgcccaccctggagcgcttccccatcagcttcaagacctacttctcagggaactacttccgccacatcgtgctgggggtgaacttcgcgggccgctacggtgcgctgggcatgagtcggcgcgaggacctgatgtacaagccgcccgccttccgcacgctcagcgagctcgtgctggacttcgaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaagattggcaaagggacgggccctccctctcccaccaaggaccggaagaaggatgtttcttccccgcagcgggcccagtccagcccccaccgcaggaacagccgcagtgaaagacggccctcgggtgacaagaagacttccgagcccaaagccatgccagaccttaacgggtaccagatccgggtctgaggcggatgccagcaccccaggccccacccactcttgggggccaggatccacctgctggaaccagccttatgcatggggaaggcggggctggtgacaaggcagggcaagaggctgcaggaagagtgtgttccagctcagccccccaagctgctctcgctcccactgagccaagccccctaactttgggcctagaggccgttagtattttatttggagtttttaactctacaactgaagtttaaggtatttggggaaaacttagtccaaatggatctgctgatggtgggaaggccagtgcttaacaaatccatgtgtcatggggccaggtgagggaaactgctggttctgctggtgcctctgcccctggcttctctctgggagttgggtgcatcttatcagtgggaaatctcccagccttaccaggcctgtgatggggggtgggggtggggtggagatgtttctccagttctgcctgccctggcagaatcttgacccagggaaagggaagcagggtaggagtccttctgagaaaggtctgtgtagcccattaaccaggagcttggcacaggccacatctgccccaagagcatgagctcgtggctcaggagagccttcaggcccttgaggcccccatgggcagtgctgtgtgggcagaggaggggtgatatgagagcgagcccagggaaggacctctgggcaaaaagttcccaggccctaactgcgtctacttgctcagtcccagctctgcctgttgctctagcccacaggctccctgcggagggtctgggcttggcggaggacccagaatggcactgaggccagcatggctgtgggagttgagcaaaccctgggtgccagtccaggagctgtggctggacatggggtgatggggcgggatgcttgggcctgggtctctccgccagcagtgccaggagcccttgctggggaaatcaagaccagactaggatgcttctgccccaggcctgccttccattctttaacagcccatcttggcttggggttgcaatgatggctgggccagtcacttgtggcagggcatcagggccctggcagggaagaacctaggcacctggggttgtccccagcctgcccgtcagcatgagatacccagtgggaaagtgagaggatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaatggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgaagggctgtgtggggactatggctacctgaagagggcacaccctgttaaaggggccacagctgctcagctgttcttacagtgccggccctgtgttgccagattgtctgctttgtcagaggccagaattctgactttttatgtgaaataggatttttaaatgctggtgatcacttaaaaaaaacttaaaaacccaatactggcaaaagaggatgccagtttgcaatccctgaagtagagagagctcgtgctggggagaagtccaccaagatgctttgaggcgggctgtagcaaagtcctgtttctcagagctgggctgggctggggtaggatccttgcagctgaggaggaggaaaagccactgagtctcctcccagagcgggacaaaccagaggccctttgcagttgctgggtcaccagcgggggtggcgcatggagtacagacagtgtagctcttggcctgccagggagacggatggtgcctttgaagcaaagaggaagggaaggcagaaccagggatgcctttgctgatgagagtgcctgtcagggaaggcgccacaggctggcagctcttcaaaccagcagcgcttgacccagagccagatccagcatggcctggccagaggcaccctgggaggccagctggtcagtcccttgcctccccaagttccccctggggtcaatgagccctgggaggatgcctaacctaactccagccagactaataggggcatggtgacccttgactcaccatcccatcccagctttcagggagtgggggtagtgtggtctccatgttcctactatgcctaagaagagatggctcaccttgggaggtgccaggctgaaactaggtcctttccgggtctggatgctgccgctcaggagcaggggcgtggcctcagctgcctctgggagcttcccgggaatgacagggtttgaggggagtagatatgagagggagccgctcctggttctggagtcttaggaggttccaacttgcaggatcctttcccagagccctccatggagaaaacagcaaaatgaagcccttacctgcttgctgtctgcaagggagggagccgagccccagctgataatcccccagcactcacccttcctgagctgagacttcggggctgtggagaccagcacaggacatagtggtgctttttaaatttatttttaactgtttctcatatgtagcaacccctcctcccctcctgggcatgtttacacaggctctgctctgggggctggcctggctgtgaggtttctggggaggcagagaggcagggactttggggccttagtcaccatccatggtatcacctcatctcacttcctgtgagggacagggcctggctgatgtgatcccagctccccccagttcaggactgtctttcagctcctttgcccctggaggtgggggctgctggctgaggaggggtcaaggtgagttcaagaaagctacctgtggaaaatggaccaggttgggggggtgattgcaaagtctccccaaagcctggctcctcatgctcagtgccaggggcagaacactggggagccaggtatagagagccttcctgtcataactgccagtcctcttcctccaaggcctctgcatattctcatgttcccctcacccatcatgccagccacccctatccctcttctagcagggccaagatggggacagcagcagccctctggccttgggatgtgatgataaagcaagcctagggccagggtttggggagcagagagagccaagaagttgaccacgtgtgatttccagcccttcccactgggacttgacttcccaggtcaaggagtccgtctcattctggctggtcgagtgaccagaggcctgtgtgaatgtgtgcacctgcttttcctgcctggaatgttttctggctcagctgcagcaacatctgtgagcccagtgtctgccctgtgtccctgggctcgctccaagtgcaggaacatacatgcagggcccaacatgatgatggtgtgaagggcaggaaacagtcctctgaaggagtggggaggtgggcagtctgcccccgccaggtaccatcgcctcctgccagcttccttagaccaggcagggctgccatggtgctagctgcaagtccatcagtattgaccgtctcgctccatcttggtcctccggagtcccaagtttccttttcatcaaatctgacaagagagaagaaacatgggtgtgcttggcccacagggcctggtggtgatggacctccccgctccctcaagctctggatggctgcagtgttgtactagactttgttcaggctgttctcatctcagtattgccccttcctttcactttcacacttcatctcattcctgttgtcactttccccgaaacgaataaagtctccccagctcctgctgtgtaggctgggcagaaaccacaacacgtaagccttg

SEQ ID NO: 377147 - DNA, 2314 bp, Homo sapiens
cctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttctggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctatatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatgttttccagtcacacccccgcctccaacccaaagggcagaagtggggcctgtagctgagtcaccagggtagccttggagacagaccagccaccaggagaggctgtcctccccagccccacagtcaacagcgggagaggaggaagtgtttatggctggttctccatcctaactggtcaatgcctgagccctaccttttcttctcagtcattttattattaaaaatgtcataaatacacgtgaaacctagaacaacatcatgaactcctgtgcacccgttactcagcttcaccaactcaaagccaattctgtttcatctcttccaccctgcccgtattctttaccagcttttaaacattttgcctgcgcccctggggtaggcagcccactgggctcagtgctgcagaggagcacagattaggtgggagccaagagggtgacggggagggggtctgatggaacaggagtcccatctgagggcaggtcctgggaggactgtgatccaggggtccatccccaccccccacacagacatgcctgcctgaagttcacacaaagaggctgcgggtgcccttctcttcccgcagaggtctcggagggaacgccactatggcaggcatttgctaacagggcaggcccatttctggagcccgacatccctgccctgtttatggggttctttgctgggataagcctgaggccacccgagaaattcaggctgcaggcagtgcctccttcatgtcttcacgttcacttctccctcaggggtcacacaccaaagtggaggctcccaccctcataggagagagactggtccttttccccaggaggacacacagaagtcac

SEQ ID NO: 377148 - DNA, 4010 bp, Homo sapiens
cctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttctggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctatatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatttacctcaccaacagcatgcccaccctggagcgcttccccatcagcttcaagacctacttctcagggaactacttccgccacatcgtgctgggggtgaacttcgcgggccgctacggtgcgctgggcatgagtcggcgcgaggacctgatgtacaagccgcccgccttccgcacgctcagcgagctcgtgctggacttcgaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaagattggcaaagggacgggccctccctctcccaccaaggaccggaagaaggatgtttcttccccgcagcgggcccagtccagcccccaccgcaggaacagccgcagtgaaagacggccctcgggtgacaagaagacttccgagcccaaagccatgccagaccttaacgggtaccagatccgggtctgaggcggatgccagcaccccaggccccacccactcttgggggccaggatccacctgctggaaccagccttatgcatggggaaggcggggctggtgacaaggcagggcaagaggctgcaggaagagtgtgttccagctcagccccccaagctgctctcgctcccactgagccaagccccctaactttgggcctagaggccgttagtattttatttggagtttttaactctacaactgaagtttaaggtatttggggaaaacttagtccaaatggatctgctgatggtgggaaggccagtgcttaacaaatccatgtgtcatggggccaggtgagggaaactgctggttctgctggtgcctctgcccctggcttctctctgggagttgggtgcatcttatcagtgggaaatctcccagccttaccaggcctgtgatggggggtgggggtggggtggagatgtttctccagttctgcctgccctggcagaatcttgacccagggaaagggaagcagggtaggagtccttctgagaaaggtctgtgtagcccattaaccaggagcttggcacaggccacatctgccccaagagcatgagctcgtggctcaggagagccttcaggcccttgaggcccccatgggcagtgctgtgtgggcagaggaggggtgatatgagagcgagcccagggaaggacctctgggcaaaaagttcccaggccctaactgcgtctacttgctcagtcccagctctgcctgttgctctagcccacaggctccctgcggagggtctgggcttggcggaggacccagaatggcactgaggccagcatggctgtgggagttgagcaaaccctgggtgccagtccaggagctgtggctggacatggggtgatggggcgggatgcttgggcctgggtctctccgccagcagtgccaggagcccttgctggggaaatcaagaccagactaggatgcttctgccccaggcctgccttccattctttaacagcccatcttggcttggggttgcaatgatggctgggccagtcacttgtggcagggcatcagggccctggcagggaagaacctaggcacctggggttgtccccagcctgcccgtcagcatgagatacccagtgggaaagtgagaggatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaatggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgaagggctgtgtggggactatggctacctgaagagggcacaccctgttaaaggggccacagctgctcagctgttcttacagtgccggccctgtgttgccagattgtctgctttgtcagaggccagaattctgactttttatgtgaaataggatttttaaatgctggtgatcacttaaaaaaaacttaaaaacccaatactggcaaaagaggatgccagtttgcaatccccgctccctcaagctctggatggctgcagtgttgtactagactttgttcaggctgttctcatctcagtattgccccttcctttcactttcacacttcatctcattcctgttgtcactttccccgaaacgaataaagtctccccagctcctgctgtgtaggctgggcagaaaccacaacacgtaagccttg

SEQ ID NO: 377149 - DNA, 3729 bp, Homo sapiens
cctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttctggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctatatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatttacctcaccaacagcatgcccaccctggagcgcttccccatcagcttcaagacctacttctcagggaactacttccgccacatcgtgctgggggtgaacttcgcgggccgctacggtgcgctgggcatgagtcggcgcgaggacctgatgtacaagccgcccgccttccgcacgctcagcgagctcgtgctggacttcgaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaagattggcaaagggacgggccctccctctcccaccaaggaccggaagaaggatgtttcttccccgcagcgggcccagtccagcccccaccgcaggaacagccgcagtgaaagacggccctcgggtgacaagaagacttccgagcccaaagccatgccagaccttaacgggtaccagatccgggtctgaggcggatgccagcaccccaggccccacccactcttgggggccaggatccacctgctggaaccagccttatgcatggggaaggcggggctggtgacaaggcagggcaagaggctgcaggaagagtgtgttccagctcagccccccaagctgctctcgctcccactgagccaagccccctaactttgggcctagaggccgttagtattttatttggagtttttaactctacaactgaagtttaaggtatttggggaaaacttagtccaaatggatctgctgatggtgggaaggccagtgcttaacaaatccatgtgtcatggggccaggtgagggaaactgctggttctgctggtgcctctgcccctggcttctctctgggagttgggtgcatcttatcagtgggaaatctcccagccttaccaggcctgtgatggggggtgggggtggggtggagatgtttctccagttctgcctgccctggcagaatcttgacccagggaaagggaagcagggtaggagtccttctgagaaaggtctgtgtagcccattaaccaggagcttggcacaggccacatctgccccaagagcatgagctcgtggctcaggagagccttcaggcccttgaggcccccatgggcagtgctgtgtgggcagaggaggggtgatatgagagcgagcccagggaaggacctctgggcaaaaagttcccaggccctaactgcgtctacttgctcagtcccagctctgcctgttgctctagcccacaggctccctgcggagggtctgggcttggcggaggacccagaatggcactgaggccagcatggctgtgggagttgagcaaaccctgggtgccagtccaggagctgtggctggacatggggtgatggggcgggatgcttgggcctgggtctctccgccagcagtgccaggagcccttgctggggaaatcaagaccagactaggatgcttctgccccaggcctgccttccattctttaacagcccatcttggcttggggttgcaatgatggctgggccagtcacttgtggcagggcatcagggccctggcagggaagaacctaggcacctggggttgtccccagcctgcccgtcagcatgagatacccagtgggaaagtgagaggatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaatggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgagggacagctgggaactgggggatgcaagtgagaaagggatgtgggggagagttcaggatcaggctgcttgaggagtaatgggttacctacagcagagacgagatggctgtttgtcaggaggcggcagaaaggtaa

SEQ ID NO: 377150 - DNA, 1774 bp, Homo sapiens
cctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttctggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctatatcagagagctgcagtatcctctctggtcaagggtcatggccaccttctggccggtgtggtgggccttgtttccaggcagagctggagaggtatcagcagagccgcctcattccacaacgccagggccaccattcacgtgacatctctgtgctccctggtgctgtgggacgcggcgcgtgtgcctcctgggtgtcggaggaattttgtctgatgagtgcagggcccactctgcactctctgccacccccttcccgctcctgccgtgtgatggggtaaagagaggaaaatgggtcctgagtgacttgctggtggggtggccaagtctagatagatctcatgctctgttgtccacccagccctagcagagggggagagagggagctgccttggggcttttaaaagtctgattttgaataaagggaaaaatggcagagaaaaaggaaaaaaaa

SEQ ID NO: 377151 - DNA, 1918 bp, Homo sapiens
cctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttctggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctatatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatgtatccttcctcacctgaaggggaggggtccgggcttctctgggcctcagcttcctgctctgaaagtgagggtggggtaggttgaatgggctccagggctctcccatatgcagtcatctgcttggccccaagatggagaagcaccccactaaagtggaagaaccccccaaaatggaggagccccgaggtcccagtaccccacatctcagttgctaccttcccaggcttactgggcagctcttttttgagtcacgtggatacagggaccgttttctgaaccccaaatcagggcacagtgtctcacaaagacagttgtaccatttccaagaactagacagtctgggaggcacagttggaatgcccagatgttggcatttccagaacatgttgatttctggacgagatattaaagcaaaactgccttaaaaaaaaaaaaaccacaaacaag

SEQ ID NO: 377152 - DNA, 5701 bp, Homo sapiens
cctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttctggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctatatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatttacctcaccaacagcatgcccaccctggagcgcttccccatcagcttcaagacctacttctcagggaactacttccgccacatcgtgctgggggtgaacttcgcgggccgctacggtgcgctgggcatgagtcggcgcgaggacctgatgtacaagccgcccgccttccgcacgctcagcgagctcgtgctggacttcgaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaagattggcaaagggacgggccctccctctcccaccaaggaccggaagaaggatgtttcttccccgcagcgggcccagtccagcccccaccgcaggaacagccgcagtgaaagacggccctcgggtgacaagaagacttccgagcccaaagccatgccagaccttaacgggtaccagatccgggtctgaggcggatgccagcaccccaggccccacccactcttgggggccaggatccacctgctggaaccagccttatgcatggggaaggcggggctggtgacaaggcagggcaagaggctgcaggaagagtgtgttccagctcagccccccaagctgctctcgctcccactgagccaagccccctaactttgggcctagaggccgttagtattttatttggagtttttaactctacaactgaagtttaaggtatttggggaaaacttagtccaaatggatctgctgatggtgggaaggccagtgcttaacaaatccatgtgtcatggggccaggtgagggaaactgctggttctgctggtgcctctgcccctggcttctctctgggagttgggtgcatcttatcagtgggaaatctcccagccttaccaggcctgtgatggggggtgggggtggggtggagatgtttctccagttctgcctgccctggcagaatcttgacccagggaaagggaagcagggtaggagtccttctgagaaaggtctgtgtagcccattaaccaggagcttggcacaggccacatctgccccaagagcatgagctcgtggctcaggagagccttcaggcccttgaggcccccatgggcagtgctgtgtgggcagaggaggggtgatatgagagcgagcccagggaaggacctctgggcaaaaagttcccaggccctaactgcgtctacttgctcagtcccagctctgcctgttgctctagcccacaggctccctgcggagggtctgggcttggcggaggacccagaatggcactgaggccagcatggctgtgggagttgagcaaaccctgggtgccagtccaggagctgtggctggacatggggtgatggggcgggatgcttgggcctgggtctctccgccagcagtgccaggagcccttgctggggaaatcaagaccagactaggatgcttctgccccaggcctgccttccattctttaacagcccatcttggcttggggttgcaatgatggctgggccagtcacttgtggcagggcatcagggccctggcagggaagaacctaggcacctggggttgtccccagcctgcccgtcagcatgagatacccagtgggaaagtgagaggatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaatggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgaagggctgtgtggggactatggctacctgaagagggcacaccctgttaaaggggccacagctgctcagctgttcttacagtgccggccctgtgttgccagattgtctgctttgtcagaggccagaattctgactttttatgtgaaataggatttttaaatgctggtgatcacttaaaaaaaacttaaaaacccaatactggcaaaagaggatgccagtttgcaatccctgaagtagagagagctcgtgctggggagaagtccaccaagatgctttgaggcgggctgtagcaaagtcctgtttctcagagctgggctgggctggggtaggatccttgcagctgaggaggaggaaaagccactgagtctcctcccagagcgggacaaaccagaggccctttgcagttgctgggtcaccagcgggggtggcgcatggagtacagacagtgtagctcttggcctgccagggagacggatggtgcctttgaagcaaagaggaagggaaggcagaaccagggatgcctttgctgatgagagtgcctgtcagggaaggcgccacaggctggcagctcttcaaaccagcagcgcttgacccagagccagatccagcatggcctggccagaggcaccctgggaggccagctggtcagtcccttgcctccccaagttccccctggggtcaatgagccctgggaggatgcctaacctaactccagccagactaataggggcatggtgacccttgactcaccatcccatcccagctttcagggagtgggggtagtgtggtctccatgttcctactatgcctaagaagagatggctcaccttgggaggtgccaggctgaaactaggtcctttccgggtctggatgctgccgctcaggagcaggggcgtggcctcagctgcctctgggagcttcccgggaatgacagggtttgaggggagtagatatgagagggagccgctcctggttctggagtcttaggaggttccaacttgcaggatcctttcccagagccctccatggagaaaacagcaaaatgaagcccttacctgcttgctgtctgcaagggagggagccgagccccagctgataatcccccagcactcacccttcctgagctgagacttcggggctgtggagaccagcacaggacatagtggtgctttttaaatttatttttaactgtttctcatatgtagcaacccctcctcccctcctgggcatgtttacacaggctctgctctgggggctggcctggctgtgaggtttctggggaggcagagaggcagggactttggggccttagtcaccatccatggtatcacctcatctcacttcctgtgagggacagggcctggctgatgtgatcccagctccccccagttcaggactgtctttcagctcctttgcccctggaggtgggggctgctggctgaggaggggtcaaggtgagttcaagaaagctacctgtggaaaatggaccaggttgggggggtgattgcaaagtctccccaaagcctggctcctcatgctcagtgccaggggcagaacactggggagccaggtatagagagccttcctgtcataactgccagtcctcttcctccaaggcctctgcatattctcatgttcccctcacccatcatgccagccacccctatccctcttctagcagggccaagatggggacagcagcagccctctggccttgggatgtgatgataaagcaagcctagggccagggtttggggagcagagagagccaagaagttgaccacgtgtgatttccagcccttcccactgggacttgacttcccaggtcaaggatcccaagtttccttttcatcaaatctgacaagagagaagaaacatgggtgtgcttggcccacagggcctggtggtgatggacctccccgctccctcaagctctggatggctgcagtgttgtactagactttgttcaggctgttctcatctcagtattgccccttcctttcactttcacacttcatctcattcctgttgtcactttccccgaaacgaataaagtctccccagctcctgctgtgtaggctgggcagaaaccacaacacgtaagccttg

SEQ ID NO: 377153 - DNA, 2762 bp, Homo sapiens
cctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttctggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaagatccccataccgagtgtgcctacgttccagccgtctacacctgtccctgagcgcctggaagctgtgcagcgctatatcagagagctgcagtacaatcacacagggacacagttctttgaaattaagaagagcagacctctgacagggctgatggacctggccaaggaaatgaccaaagaggccctgccaatcaaatgcctggaagccgtgatcctgggaatgtatccttcctcacctgaaggggaggggtccgggcttctctgggcctcagcttcctgctctgaaagtgagggtggggtaggttgaatgggctccagggctctcccatatgcagtcatctgcttggccccaagatggagaagcaccccactaaagtggaagaaccccccaaaatggaggagccccgaggtcccagtaccccacatctcagttgctaccttcccaggcttactgggcagctcttttttgagtcacgtggatacagggaccgttttctgaaccccaaatcagggcacagtgtctcacaaagacagttgtaccatttccaagaactagacagtctgggaggcacagttggaatgcccagatgttggcatttccagaacatgttgatttctggacgagatattaaagcaaaactgccttaaaaaaaaaaaaaccacaaacaaggttttccagtcacacccccgcctccaacccaaagggcagaagtggggcctgtagctgagtcaccagggtagccttggagacagaccagccaccaggagaggctgtcctccccagccccacagtcaacagcgggagaggaggaagtgtttatggctggttctccatcctaactggtcaatgcctgagccctaccttttcttctcagtcattttattattaaaaatgtcataaatacacgtgaaacctagaacaacatcatgaactcctgtgcacccgttactcagcttcaccaactcaaagccaattctgtttcatctcttccaccctgcccgtattctttaccagcttttaaacattttgcctgcgcccctggggtaggcagcccactgggctcagtgctgcagaggagcacagattaggtgggagccaagagggtgacggggagggggtctgatggaacaggagtcccatctgagggcaggtcctgggaggactgtgatccaggggtccatccccaccccccacacagacatgcctgcctgaagttcacacaaagaggctgcgggtgcccttctcttcccgcagaggtctcggagggaacgccactatggcaggcatttgctaacagggcaggcccatttctggagcccgacatccctgccctgtttatggggttctttgctgggataagcctgaggccacccgagaaattcaggctgcaggcagtgcctccttcatgtcttcacgttcacttctccctcaggggtcacacaccaaagtggaggctcccaccctcataggagagagactggtccttttccccaggaggacacacagaagtcac

SEQ ID NO: 377154 - DNA, 241 bp, Homo sapiens
tgctctattatactatcttttattaaatttcaacctctgagaaacccacagatcttatttataagttttatccagttccaccttctggctcacctgtgtcttgctcgttttgagggataccctccagcctgaggttctgcaattcctcctgtccttctgggtactttgaggtatccttcaacaatgtctacctaaggacaaaataataaaaacaaaacaaaaaccacaaaagccaaaaatg

SEQ ID NO: 377155 - DNA, 498 bp, Homo sapiens
atgttgatcaggaacaacctccccacccccacccatgtctcacaaggataataaaattgatgcaaatctaatctgggagacttgatatctcgtaaactagattttaatcatttcagaaatgtattcacttcttaatgatttttaagtcactcagaattttgtagctttcctcatatagatgacatatatttctggccaagtttattctttgttactgtagtaaatggttttatttttttccattgttttctaacaaatttgtcttggcatatattaaaattatttctctttaataatttgataattaggcttcttataaaactcttactagacaggtactttcagctaattctttttgggttttccatttaacactaatataatttgtaagttattttattttgcctcctttttttctgtgtctcatcttatttcaaccttgcctcccttctaattgctttggttagaatttctttgggcaatagttttttttttttt

SEQ ID NO: 377156 - DNA, 2106 bp, Homo sapiens
atgcgcacggcccagcctttatagcggccgcgggggccttgccttccgcactcgggcgcagccgggtggatctcgagcaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagc

SEQ ID NO: 377157 - DNA, 622 bp, Homo sapiens
atgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccggtgagtgggggagctggggtgcgtccaggcggtcgcaggggctgagcaccagcgggtacaagcgggactcagatccagccccttgggcttcagccctaccgcctgaggaggaa

SEQ ID NO: 377158 - DNA, 2076 bp, Homo sapiens
atgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagc

SEQ ID NO: 377159 - DNA, 2382 bp, Homo sapiens
atgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagc

SEQ ID NO: 377160 - DNA, 1155 bp, Homo sapiens
agtgctgactgcctcttatctagattaacttgaaacattcaggattttccagtttttaagaagaaacaacttttgatccttttggatatcttttatgtgtctcccccattaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagc

SEQ ID NO: 377161 - DNA, 1906 bp, Homo sapiens
atgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagttccttgatattgccccaaaaatgtgctaatgtcacgaacatcgaaataatggggacgacggggagccatactacgctgttggccacgggaccccaaacccagagtccagtgcccacaaacaacgcaacggcacagcggacatctggagaggccgtcgaagggtcagaggatacagcgaaaccctcgagctgcacgtcacgcgtatgctctaggggcggc

SEQ ID NO: 377162 - DNA, 489 bp, Homo sapiens
taactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggtaaggtccttgttctttataggagaagggaacagaaaaaacggttcagtgaatttaggagtaaataaaaatttaagcatttatttcattaaacaaacac

SEQ ID NO: 377163 - DNA, 2593 bp, Homo sapiens
atgcgcacggcccagcctttatagcggccgcgggggccttgccttccgcactcgggcgcagccgggtggatctcgagcaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgtaagctggcttac

SEQ ID NO: 377164 - DNA, 2050 bp, Homo sapiens
atgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcagcaaaataagtttaaaagggaatctgtggcattcaaccgataaacagaagatcactaagagatgaaaaaaagctactcttggagctcacttcccccaacaagagcaccacattcctaacccctaaggcagcacacagagtccaaaaa

SEQ ID NO: 377165 - DNA, 2430 bp, Homo sapiens
atgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagc

SEQ ID NO: 377166 - DNA, 2376 bp, Homo sapiens
atgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccaccagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagc

SEQ ID NO: 377167 - DNA, 2267 bp, Homo sapiens
  misc_feature (2221)..(2221): n is a, c, g, or t
  misc_feature (2228)..(2228): n is a, c, g, or t
  misc_feature (2254)..(2254): n is a, c, g, or t
  misc_feature (2261)..(2261): n is a, c, g, or t
atgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaaatgtttcaaacttttctcaaatatctggngatcgtnagctgtctttttaaattgaaaagtgnggcactnaaaact

SEQ ID NO: 377168 - DNA, 405 bp, Homo sapiens
agtggtaaaggctatttgtttgcttctttttcaaatttaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggtaaagtggtgagggttatcttctgttacagtgatgggtattccattttggacctctaagtgcagtgctgactgcctcttatctagattaacttgaaacattcaggattttccagtttttaagaagaaacaacttttg

SEQ ID NO: 377169 - DNA, 380 bp, Homo sapiens
taacagaccatatttgagatgacagatgcaaaataaacaggcatgactttagacaggtccagaatggtcttaatatcctgaagcttattcttattcaaacttcgcgttttaattgtttggaattcttagacagagtaggtggaatttcatcctttgtatgttttaaggagagcttcgctcctctctttaccacccaccccccgccacccagtaaaatactgaactttcattttaatccataacactaaatgcttttgtgtttttctttcttcaaagactgtcattaagaatgtctacaaggaaatcatgggaaatgacaaaatctcccccagattgattttttacgtgttgttggaaataaccacataactaaaaaaaaa

SEQ ID NO: 377170 - DNA, 476 bp, Homo sapiens
agagccctgggagaagacatagagcaattatgcagggctctgaagagtaaatcatagcaggcaggctggggagggaaattattagacagcagtgagtttcctgtgtgttgctttctcctcacatgtctcctagttgagactttgaagcagtgcaaatcatggaattgcacacatgggaaaatccaaagagttccacgaagaattccttcaggccagaggatgctaggaacgggtctctgcaggatgaagcatgtggaagagatccctgggggtgtttgtctttctttattctccttttccttcccttctctccctttttccaccccagccctgccttatggcaatagcagccacacatccagataaaacataattcactttttactcgctttcaaaatgtcaacagtaaagatgaacaggatgcaagatgaaagaacattgaaaaataaagattaacaagaaagtagtttaaataa

SEQ ID NO: 377171 - DNA, 2013 bp, Homo sapiens
agagaatgtccggattgctattggactttggagcgtatggctccaaatcaactcattggctaaaacttgacggaaaatggtggttaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377172 - DNA, 2447 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagaaaaaaaaaaaaaaaaaaaaaaaaaaaaaaaaaaaaaaaaaaaaaaaaaaaaaaaaaaaaaaaatttgaaaaaaaaaaaaaaaaaataaaaaaaataaaaaaaaaaaaacaggggggggcccagaacccaaaaccccccggggggggccggggccccaatcccccctttagggaagttttttaccccccccttttgggcggttttttaaaaat

SEQ ID NO: 377173 - DNA, 2122 bp, Homo sapiens
cctctcttcctcttgagccctttcctctcccagggcaagtgctgttaggtcacctttactccattccctccttttttcacttggtgaggcctcacacactgtacctgcccacgcaaagtgtcactagaaggaagggaaagggtagtaggattcgtttgcctgtctggaggtaggattggtctttgtagctattcaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377174 - DNA, 2974 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggcttgttgtcctcacaggagcaggcacctagcctctcctccagcagcagcacctggtcgctgagagattcgatccggtcaccccggccccacagctcagccacctgttctggctgcagctcttcaggcggcacgggcagcaccgctctgacccaggccccagcctgaccggcccactgctccagccgctccaggcgccctcgcagctcgtgaatctcctgcttcagagcgcgctcatctttttccgcctcccgaacggccacgctgagtatgctggcactggttgggggctctggggacccctccatgcaggtgcgcccgtccacgcctagcactaggtcatgggggcagccgcaggtgaagctgcctgccgtattaaaacaatggtgcgagcagagggtgatgctggtcctacattcatccacgtccacatgacagtgcttccctccccagccggg

SEQ ID NO: 377175 - DNA, 2993 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggcttgttgtcctcacaggagcaggcacctagcctctcctccagcagcagcacctggtcgctgagagattcgatccggtcaccccggccccacagctcagccacctgttctggctgcagctcttcaggcggcacgggcagcaccgctctgacccaggccccagcctgaccggcccactagaaaggaagagatgcctcagggtattgacagtgacgtctggcctcgccccacccagcaggcttggctcacctgctccagccgctccgcctcccgaacggccacgctgagtatgctggcactggttgggggctctggggacccctccatgcaggtgcgcccgtccacgcctagcactaggtcatgggggcagccgcaggtgaagctgcctgccgtattaaaacaatggtgcgagcagagggtgatgctggtcctacattcatccacgtccacatgacagtgcttccctccccagccggg

SEQ ID NO: 377176 - DNA, 2204 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377177 - DNA, 1970 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377178 - DNA, 1904 bp, Homo sapiens
tggccgacatcgggaaagacggcgaagagctaggaaaagagggaaaacactagggtcgcagggttcaaaatggctccaacctcctttggtgacgtagagagcagaacttgggtctgcccctcccttttagttaagggagcagaactgggattagcccgacgtttggatagtgggaacatcgatctgcggcgctggtgttaacccaactcattcggctggacgactcagccctccccatattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377179 - DNA, 2359 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggcttgttgtcctcacaggagcaggcacctagcctctcctccagcagcagcacctggtcgctgagagattcgatccggtcaccccggccccacagctcagccacctgttctggctgcagctcttcaggcggcacgggcagcaccgctctgacccaggccccagcctgaccggcccactgctccagccgctccaggcgccctcgcagctcgtgaatctcctgcttcagagcgcgctcatctttttccgcctcccgaacggccacgctgagtatgctggcactggttgggggctctggggacccctccatgcaggtgcgcccgtccacgcctagcactaggtcatgggggcagccgcaggtgaagctgcctgccgtattaaaacaatggtgcgagcagagggtgatgctggtcctacattcatccacgtccacatgacagtgcttccctccccagccggg

SEQ ID NO: 377180 - DNA, 2461 bp, Homo sapiens
  misc_feature (1712)..(1712): n is a, c, g, or t
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagaaaaaaaaaaaaaaaaaaaaaaaaaaaaaaaaaaaaaaaaaaaaaaaaaaaaaaaaaaaaaaaaaaaaaaagaagaggggcgcgcacccacaaaatatcaccgccggggagaggacacaacatcaagaagtcctcgccacagcatagttttgtataagaagggggcgccccagaagtagcagcagcagaataatatataaaagcacgagacagggcgccgccggataaaacaacgatatgaagagggagaacaanacgacgtcatccaggggtgagactactcttgtgtgaggaagaaagcacccactatctaaaactactgagaggaggagcgagacaccacaatatgtgggcacacacaaccatctccctcagcaagaagatattatatacaaaccccccactagagaggaaatataaatatcaaaacataatctaccaacgagagtacttatatatcgggtgtgtcaaacacacacacactcacggcgacacacattacaactgcttggggcacgcaacggacagaaaaagaacaagattatctggtcgagccacctcacagcaggtacgatatatattctagttacgtcgacgacacacaatacaatttttatcccaacacagcgggcgggggggttgtttttcagtatagtaaacataaactctcaagagagagcgaaaacagaaacgagaagcgcacagaaacaaacagaaacagagccaacacacaacacgaagaagagaaccaaaacaactacagaagaaaagaaaaagagaagagagcaacgacgaagaaacggaacacgaacaagacaaaccaacagagcaaccagacaaagcaagacacaagaaaaggaacgacggacgcgaagagaggagacagaggaagggacgaccgctgcgcacggcaacacagacgcacagacaaaacaagaaacagaagacaaacacacacaaaacaaaaacaaaacaaacgcacgacaagaagaaagaagaaagaa

SEQ ID NO: 377181 - DNA, 617 bp, Homo sapiens
tactggccaatgtggggtagaggggtagagaagaccacataggaagagactccactggggatggaatgttcccctcccttgtgtagctgagtcagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377182 - DNA, 2235 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377183 - DNA, 3238 bp, Homo sapiens
  misc_feature (2489)..(2489): n is a, c, g, or t
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagaaaaaaaaaaaaaaaaaaaaaaaaaaaaaaaaaaaaaaaaaaaaaaaaaaaaaaaaaaaaaaaaaaaaaaagaagaggggcgcgcacccacaaaatatcaccgccggggagaggacacaacatcaagaagtcctcgccacagcatagttttgtataagaagggggcgccccagaagtagcagcagcagaataatatataaaagcacgagacagggcgccgccggataaaacaacgatatgaagagggagaacaanacgacgtcatccaggggtgagactactcttgtgtgaggaagaaagcacccactatctaaaactactgagaggaggagcgagacaccacaatatgtgggcacacacaaccatctccctcagcaagaagatattatatacaaaccccccactagagaggaaatataaatatcaaaacataatctaccaacgagagtacttatatatcgggtgtgtcaaacacacacacactcacggcgacacacattacaactgcttggggcacgcaacggacagaaaaagaacaagattatctggtcgagccacctcacagcaggtacgatatatattctagttacgtcgacgacacacaatacaatttttatcccaacacagcgggcgggggggttgtttttcagtatagtaaacataaactctcaagagagagcgaaaacagaaacgagaagcgcacagaaacaaacagaaacagagccaacacacaacacgaagaagagaaccaaaacaactacagaagaaaagaaaaagagaagagagcaacgacgaagaaacggaacacgaacaagacaaaccaacagagcaaccagacaaagcaagacacaagaaaaggaacgacggacgcgaagagaggagacagaggaagggacgaccgctgcgcacggcaacacagacgcacagacaaaacaagaaacagaagacaaacacacacaaaacaaaaacaaaacaaacgcacgacaagaagaaagaagaaagaa

SEQ ID NO: 377184 - DNA, 2532 bp, Homo sapiens
atgagaagttagcagttgcgtaaagaaggactggggcagatgaggattcaggaagcttgaggtttaggaaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggcaagtaaggagactgatacgaaggaagtaggaaagaaaaggtacagaggtaaaagagcatggaaaaggaaagggtcagggataaggccaaagagatctcttctctttaaaggccagagaaggcaggtggaggggggagctggactgctgggagatagtgagggacaaagggcaaaggaaaccagaccagaggactggagagtgagatggagtgagatggagtcctggagagaaaaagaagagaggtgaacttaatgcttgtcatataggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377185 - DNA, 1981 bp, Homo sapiens
tttgggcttttcctacaatcactgaccctcactgtgactaaaggagcagaattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377186 - DNA, 2169 bp, Homo sapiens
tggccgacatcgggaaagacggcgaagagctaggaaaagagggaaaacactagggtcgcagggttcaaaatggctccaacctcctttggtgacgtagagagcagaacttgggtctgcccctcccttttagttaagggagcagaactgggattagcccgacgtttggatagtgggaacatcgatctgcggcgctggtgttaacccaactcattcggctggacgactcagccctccccatattaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377187 - DNA, 2701 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtctgctccagccgctccaggcgccctcgcagctcgtgaatctcctgcttcagagcgcgctcatctttttccgcctcccgaacggccacgctgagtatgctggcactggttgggggctctggggacccctccatgcaggtgcgcccgtccacgcctagcactaggtcatgggggcagccgcaggtgaagctgcctgccgtattaaaacaatggtgcgagcagagggtgatgctggtcctacattcatccacgtccacatgacagtgcttccctccccagccggg

SEQ ID NO: 377188 - DNA, 1972 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377189 - DNA, 1034 bp, Homo sapiens
  misc_feature (27)..(27): n is a, c, g, or t
  misc_feature (48)..(48): n is a, c, g, or t
cttctgacctttgatccgctaggcccnccatctctgaaccctagagcnccgctttctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagcccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377190 - DNA, 1620 bp, Homo sapiens
ggaagtcagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagaga

SEQ ID NO: 377191 - DNA, 515 bp, Homo sapiens
ccagaagctcagcagttgcctgtgctgtgcttatacagcctgcagaactgtgagccaattaaacctcttttctttatagattaccctggctcagatatttctttatagcaatgcaagaatggactcacaaagatactttcgggcatgccgaggcaagcagctgaagggtcttcatagccaaatttgctcacaggtggggcctcctgcccacctcccaactgcccaccaccttacccttctcccacctgccagagggattgcttgaaaatgcaaatcaggccctgcaatgaccccctcttgctgccagggaagcagactgctcccaaggaccccctgcccagctcatcgctgccgtcttcagccgtcttccctggccatacaggtgcctttgctcacccagggcatcaaattcccaactgtctgggcctctgcgtatgctattctgaattcttagaatattcttcatccttcttttttactcctgttattcactgggaggctcagcttttctttca

SEQ ID NO: 377192 - DNA, 422 bp, Homo sapiens
  misc_feature (347)..(347): n is a, c, g, or t
actgagtttacaacattgagatcaggccctctgagagacctttactcctctgtcatcatatctataaatattcagatattagtggtgttagaaaataaaggaaggactgttacagagctagactttaggtttaagtttattaagcattaggtttacagcctggggcaacatagggagaccccatttctacaaaacagaataaattaggctgggcttgggtgggcatttgcctgtgggtcccagctgttaagggagacttgaggtagggagcattgctttgagcctgggggagggtgaaggctgttagttgagggtgttgatgttcacccacttgcattttccagccntagggccaaccaggagctttttaggatttacctttccaagtttcttttaagttaccattttttagggggtatttg

SEQ ID NO: 377193 - DNA, 475 bp, Homo sapiens
agggtgaacctaagacagtctgtaggctgcccgggctagagtttgctctttggttttcagagtctggggtttcagcttaaagacaggcacaggccagctgcctcaccactggctgtggcgagtgatgtggtccctgagggtggcgtttctgccgacgctggtgcagtacagggtcctgtcttgtccctgtcacccacttggcaaggggctgggagcaggagtgagggaagatgctgtggttgtgctgaggcctgggccacacatgtgtgacgctcgaggtgacaggcagaagcttattctttcattgtccagggaaaccccatgtgtaggaacgtgcttgttttatgacctcttcccctgtgcttcgcagctggctttttgggacctatgtacaccccagccattagatgatgccaacagtcttgttgcagtagggcactggctgccagcctgtgggggtcatttggggttttgg

SEQ ID NO: 377194 - DNA, 575 bp, Homo sapiens
cgaggcagcgcaggcggtgcagctcggccagcttgccgttcctctccctttctctcagcatcttcttggtagcctgcctgtaggtgaagaagcaccagcagcatccatggcctgtcttttggcttaacacttatctcctttggctttgacagcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacgtatgtactttaggagtttgcctcctcgaagaagctatttgcataagagatgctcttatcacagtcaatataagatggccacagttttctcggatattgtgtactatttgctttcctcatttctgagtaaattgtaattattcaatataaacagttcttagatttatgctaaaaaggtaaaaatttttcatcatgtgttcagtttttatcacatttttctttctttcttttttttt

SEQ ID NO: 377195 - DNA, 531 bp, Homo sapiens
tgcaacctgtgtatctaacttttcatctcttttcttctccttacagtccagaccttttagccctcccattcattcttccagccctcctccaatagcacccttagcgcgggctgaaagcacttcttcaatatcgtcaaccaattccttgagcgcagccaccactcccacagttggtaaaaattctctcctctcttttaatccgtttgtggttttgactggctattttttatgatctgaaatccccaaggccctgtgtttctggttgaaattgttttgctgtgtgttttgctactattacctgactcttcttttaaaaccaccttctcagcaaaggaggcaaagtgctttacctaagcaaatgaacaaataaaagaacattaacacctgtgttttgcaggaattttcttatgctgttccatacagagctattcaaaaaataagtaagaaatcgccaaggaaggtcttgtaatttagatattatttcttaaaataaaaatagtctcctttgaggggaaatgtttgtttaaattc

SEQ ID NO: 377196 - DNA, 1010 bp, Homo sapiens
ttaacattttaatttcctctcatagaatcatcacaaaataagaaaacacttctttatatcgtaatcataattccagtgttttcagttttgtttcctttttccactaaaatcattcctgtgtttcaatcagtaaagtgggcttcttgatttcatttgggatttgtatttgtgtttttgttttccattcgtttatgtttctttggttcgtagtgtcagaagacgatgttttttatgacaaactgccctcgtttgaaaggcgctgtgaaacgcctgcaggtatggtgctagccaagtgatctctagagacctagattccaaaaatccaagccattatccatctgaatgctataaacttcatggacatgccctcacctcatgagtgtccagtgcctctcagatgcaccctgtatatttactgttcatcgtggaactcgtgccactgaaaatttttaagtgactatattcaaaaacagcaggttgcatgacagtttctcagtgaagaggttcaaaaaaggtgagatgctattgctttgtgaatttacaaaggaaagaataatttaactgctcagaattacatgtccggtcactgctttttaatttaaaaaataatagagcatcattagtaatcttgttttctctttgatacataggtaaagggtgttttgtgtctggatgcctaaggtgattccaggggaggggatggaagatatgtgacatcttccctgaaatttatattgatatgcaatgctttgtcatttaaaacctaagctaatgttttctacaatccataactctgagtttatctttttggaaacatagaaggggatgacattgaagatgaaatggatacagcaattgctgaatgacagtttgcccaaattagtgcagttaaaatatgctgacgcccctgcatggccaggaagacttctgctccatgcacacaagcaccaagtatcaagcgaccaccaacacattcccattcctttaggcctccatagctttgcttttgc

SEQ ID NO: 377197 - DNA, 482 bp, Homo sapiens
ggctaggcaggaaactccaaattctgtgatatctctaacccaagtagaaggagcactgacctactttcagatcacaatggaaagaccaactgatcaattgaagtttgtaacagacctgcacaaagagaaggcttcatcaatgctgtattttcctgctgcatgaaagagttatacttcttgttgattgaaaaaacgtacaaggaaggcctttggaatacggaagaaagaaaaggacactgattctacgtatgtactttaggagtttgcctcctcgaagaagctatttgcataagagatgctcttatcacagtcaatataagatggccacagttttctcggatattgtgtactatttgctttcctcatttctgagtaaattgtaattattcaatataaacagttcttagatttatgctaaaaaggtaaaaatttttcatcatgtgttcagtttttatcacatttttctttctttcttttttttt

SEQ ID NO: 377198 - DNA, 344 bp, Homo sapiens
gtagtgtatggaatatttttatatctatttcaggcgtggcgtacttgggaggacaacgcacaggttagcctttggaatacggaagaaagaaaaggacactgattctacgtatgtactttaggagtttgcctcctcgaagaagctatttgcataagagatgctcttatcacagtcaatataagatggccacagttttctcggatattgtgtactatttgctttcctcatttctgagtaaattgtaattattcaatataaacagttcttagatttatgctaaaaaggtaaaaatttttcatcatgtgttcagtttttatcacatttttctttctttcttttttttt

SEQ ID NO: 377199 - DNA, 4741 bp, Homo sapiens
cgaggcagcgcaggcggtgcagctcggccagcttgccgttcctctccctttctctcagcatcttcttggtagcctgcctgtaggtgaagaagcaccagcagcatccatggcctgtcttttggcttaacacttatctcctttggctttgacagcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcagcccagcccacacgaaccaccctacaatagcaaagcagagtgtgcgcgtgaaggaggaaaaaaagtttcgaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggaaatgaccagtcagccacagaggtcaaaattgaaaaactaccatccatcaatgacttggacagcatttttgggccagtattgtcccccaagtctgttgctgttaatgctgaagaaaagtgggtccatttttctgatacatccccggaacatgttactccggagttgactccaagggaaaaagtggtgtccccaccagctacaccagacaacccagctgactccccagctccaggccctctcggccccccaggtcccacaggccccccagggcctcctgggcctcctcgcaatgtactatcgccgctcaatttagaagaagtccagaagaaagtcgctgagcagaccttcattaaagatgattacttagaaacaatctcatctcctaaagattttgggttgggacaaagagcaactccacctcccccaccaccacccacctacaggactgtggtttcgtcccccggacctggctcgggccctggtccggggaccaccagtggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatatt

SEQ ID NO: 377200 - DNA, 4837 bp, Homo sapiens
agcggagtttgattccagagccccactcggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcaggggaaaaaaaagacccagaagactcagcttctcctcacctctttcttctggctcagagccctctcgttaactctgtctcagaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgtgtcagaagacgatgttttttatgacaaactgccctcgtttgaaaggcgctgtgaaacgcctgcagagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatattactggttctcatgtctttgtatttatattttattttgttttattttgtatagatctagaatgaattagtaattaaacacaagggtttttttcccaaaaaataattttactgatttttaaaaatttaattaaaaacatagattacagtaatctctaacattattcaaatctttctagggattaaattagaaactatgaagaaatcctataatctcttaactggtctttatggaacagaatgggagtcaacaatttcaaaatgattgaactatgagtaaccagaacctcaatagaaaatgtatcccttcacctttcagaaaagagatcaaataataacacaataagctggtatcagggatttgcattttgacattttgttgtttctttttaattttgtagattataatctcctgttacatctatatccacagtactgtagaataagaattcatgtcctgaaaatggtcccaggcaatgaaagagtctcagttatcaaagacattaagtcagattcatttattcattttattcccaagtcagaacaaaatgaactagtaggtaataaaactattttcagtactaggggttaaaacaaaaagaaattgttctagttaaccagaacaccatttcctgaacgttatg

SEQ ID NO: 377201 - DNA, 3688 bp, Homo sapiens
tttttcctgcacgctaatggcatgtagtgcctccacccttccctatagtgagattaatgacctgctctgtaactcacattgtgtccttctctctccctttccttaacccttcccatcccgcttcaactcctggccatacagagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatattactggttctcatgtctttgtatttatattttattttgttttattttgtatagatctagaatgaattagtaattaaacacaagggtttttttcccaaaaaataattttactgatttttaaaaatttaattaaaaacatagattacagtaatctctaacattattcaaatctttctagggattaaattagaaactatgaagaaatcctataatctcttaactggtctttatggaacagaatgggagtcaacaatttcaaaatgattgaactatgagtaaccagaacctcaatagaaaatgtatcccttcacctttcagaaaagagatcaaataataacacaataagctggtatcagggatttgcattttgacattttgttgtttctttttaattttgtagattataatctcctgttacatctatatccacagtactgtagaataagaattcatgtcctgaaaatggtcccaggcaatgaaagagtctcagttatcaaagacattaagtcagattcatttattcattttattcccaagtcagaacaaaatgaactagtaggtaataaaactattttcagtactaggggttaaaacaaaaagaaattgttctagttaaccagaacaccatttcctgaacgttatg

SEQ ID NO: 377202 - DNA, 2024 bp, Homo sapiens
agcggagtttgattccagagccccactcggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcaggggaaaaaaaagacccagaagactcagcttctcctcacctctttcttctggctcagagccctctcgttaactctgtctcagaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgtgtcagaagacgatgttttttatgacaaactgccctcgtttgaaaggcgctgtgaaacgcctgcaggtatggtgctagccaagtgatctctagagacctagattccaaaaatccaagccattatccatctgaatgctataaacttcatggacatgccctcacctcatgagtgtccagtgcctctcagatgcaccctgtatatttactgttcatcgtggaactcgtgccactgaaaatttttaagtgactatattcaaaaacagcaggttgcatgacagtttctcagtgaagaggttcaaaaaaggtgagatgctattgctttgtgaatttacaaaggaaagaataatttaactgctcagaattacatgtccggtcactgctttttaatttaaaaaataatagagcatcattagtaatcttgttttctctttgatacataggtaaagggtgttttgtgtctggatgcctaaggtgattccaggggaggggatggaagatatgtgacatcttccctgaaatttatattgatatgcaatgctttgtcatttaaaacctaagctaatgttttctacaatccataactctgagtttatctttttggaaacatagaaggggatgacattgaagatgaaatggatacagcaattgctgaatgacagtttgcccaaattagtgcagttaaaatatgctgacgcccctgcatggccaggaagacttctgctccatgcacacaagcaccaagtatcaagcgaccaccaacacattcccattcctttaggcctccatagctttgcttttgc

SEQ ID NO: 377203 - DNA, 1005 bp, Homo sapiens
cgaggcagcgcaggcggtgcagctcggccagcttgccgttcctctccctttctctcagcatcttcttggtagcctgcctgtaggtgaagaagcaccagcagcatccatggcctgtcttttggcttaacacttatctcctttggctttgacagcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcagcccagcccacacgaaccaccctacaatagcaaagcagagtgtgcgcgtgaaggaggaaaaaaagtttcgaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtggtgagtgttgtgtgtgtgtgtgttaagctttagtgagattgaacagggctatgttctgcctatatgcattaagtcaagtcagaaactccttaaattgaagcctgcatatggtcaccatatcatgaattctataaatctaagaagctcattctagcttgagaaaattgtacttattttatattgcagtccttgtgcttttcaaaaaggtgaaaaatatatggaaccacattttcttttgacttattttcctgcaagcattttaaaaagaaaaaaaaataaaa

SEQ ID NO: 377204 - DNA, 499 bp, Homo sapiens
aggtaaggggtttttcttcttcagaagacttacgatttaccctttcttcctctctataatctttgagtgaaataaaaaactgatttctgtgtgtgtatctacaatttcctacttaaatgcggttctgagaaaaagttcatttccctatctgcatttatttgagttcagtttaattgcaatgacagaaataatacatattgtacataacatatatgtggtcttaaaccttatagtgtctatttctaattctagggtgcaattaaaaggaacttatccagtaagtatatcttagctaccagaaatagtgtatgatttaaaagaaagaacagttccttggatcttggagtatatgtacatatgaattatacattcctgggcttaatttttaagacttacaatttttttacttttacagcaaagaattcttgtaatgatagagggcacttgtgggttctgagtgattaatgtttaagttctgaaaataaatatgtttttggaa

SEQ ID NO: 377205 - DNA, 4821 bp, Homo sapiens
cacagatgtgcacggaggccacagacactgacatttggaattccttcaggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcagcccagcccacacgaaccaccctacaatagcaaagcagagtgtgcgcgtgaaggaggaaaaaaagtttcgaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttgtgtcagaagacgatgttttttatgacaaactgccctcgtttgaaaggcgctgtgaaacgcctgcagagaatgaacagccttccctcgtttggtttgacagaggaaagttttatttgacttttgaaggttcttccaggggacccagccccctaaccatgggagctcaggacactctccctgttgcagcagcatttacagaaacagtcaatgcctatttcaaaggagcagacccaagcaaatgtatcgttaagattaccggagaaatggtgttgtcatttcctgctggcatcaccagacactttgccaacaacccgtccccagctgctctgacttttcgggtgataaatttcagcaggttagaacacgtcctgccaaacccccaacttctctgctgtgataatacacaaaatgatgccaataccaaggaattctgggtaaacatgccaaatttgatgactcacctaaagaaagtgtctgaacaaaaaccccaggctacatattataacgttgacatgctcaaatatcaggtgtctgcccagggcattcagtccacacctctgaacctggcagtgaattggcgatgtgagccttcaagcactgacctgcgcatagattacaaatataatacagatgcaatgacgactgctgtggccctcaacaatgtgcagttcctggtccccatcgacggaggagtcaccaagctccaggcagtgctcccaccagcagtctggaatgctgaacaacagagaatattgtggaagattcctgatatctctcagaagtcagaaaatggaggggtgggttctttgttggcaagatttcagttatctgaaggcccaagcaaaccttctccattggttgtgcagttcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggtgtaatattgttaatggttttaaaatgtaattattgtatttgtaaattgtactctcattccagtaaggcagttagacacttgagttttagcattttaccattcctgaaatggatgtaatttaaactgtggtatgtaaatttaatagtagtattgttgaatggcacaatgcttacagaggtagattgcattttgtcaatatataaaatttaaatataatattgatagctgtcataaagggggtgccacatattaaagaaacttaagtggaaccagaagaaaaagaaacaaacttacttttcttcaatgcttagtatgttttactctagtgctaaataaaaactctatcttcaaatgtttagtgggttaaattgagaaactatttcagaaaaaaattctaaggttacagcatattcaaagaaaagcattagttaccactttttaaaaagcttttttttcaaactgcaaatttcataaaaatgcaaactgtgtaaacagggcctcttatttttataacttgtgtaaaaagggaaagcaattcatatttaaagtttaagtatattaaattataatcaagagtaaagaagatgttgaagtcttaactacttgcccctctctacagtttcgcaaatgtggggattgctgaataatcagtcagactaaaaccaaaattgtgattttaagatttcaagactttccgtagttgaactggttaagaatttttgcttagttactctgaatagatgatcttactcatccagtatgggggaatgatacctcacgtcttcctctttacccacaggaatcaaaacgctgagactgagaattttagggaaaaaaaagtccactgtttagatccagaaggagagttttaatcattgtttatatcatttgagaatgaaaaaataagcttcataaatgaaattctattcacattactgtgtaataaatttccttttggatgattaggattcattgtataaaactgtaaatctttgccattcttggagaagcaaaaggagagttatcaaaaatgtatgtcgtttcatcgttgcaaggtataataaaaactgtaattattcaatctggccctgccatatgaacatttagaaagacaaacttcttcgggagtctcagttgtaaaaccttccctcattaatatctgaaaatgttagtcttcctttaagtcatagaacttatttaaacataaaccaatttctattacaggttatgctattaaatagctgtaattattaagttattatttttataattagttgttaaatttcattttacacccactcaaatttaacaaagaatctttagcccctttaaattttagaattaaattaaatttttaaagttttacttctaaaatgagattgtgactggcaattgtttatagtgaaactttttaaattaatctttgtactcctctatcagtgcttgctaccaagagaatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaaatagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatattaaaaacatgtaaatattactggttctcatgtctttgtatttatattttattttgttttattttgtatagatctagaatgaattagtaattaaacacaagggtttttttcccaaaaaataattttactgatttttaaaaatttaattaaaaacatagattacagtaatctctaacattattcaaatctttctagggattaaattagaaactatgaagaaatcctataatctcttaactggtctttatggaacagaatgggagtcaacaatttcaaaatgattgaactatgagtaaccagaacctcaatagaaaatgtatcccttcacctttcagaaaagagatcaaataataacacaataagctggtatcagggatttgcattttgacattttgttgtttctttttaattttgtagattataatctcctgttacatctatatccacagtactgtagaataagaattcatgtcctgaaaatggtcccaggcaatgaaagagtctcagttatcaaagacattaagtcagattcatttattcattttattcccaagtcagaacaaaatgaactagtaggtaataaaactattttcagtactaggggttaaaacaaaaagaaattgttctagttaaccagaacaccatttcctgaacgttatg

SEQ ID NO: 377206 - DNA, 1582 bp, Homo sapiens
agcggagtttgattccagagccccactcggcggacggaatagacctcagcagcggcgtggtgaggacttagctgggacctggaatcgtatcctcctgtgttttttcagactccttggaaattaaggaatgcaattctgccaccatgatggaaggattgaaaaaacgtacaaggaaggcctttggaatacggaagaaagaaaaggacactgattctacaggttcaccagatagagatggaattcaggggaaaaaaaagacccagaagactcagcttctcctcacctctttcttctggctcagagccctctcgttaactctgtctcagaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtgaggaaaagtccgaggcgcagcccgggtgcaattaaaaggaacttatccagtgaagaagtggcaagacccaggcgttccacaccaactccagaacttataagcaaaaagcctccagatgacactacggcccttgctcctctctttggcccaccactagaatcagcttttgatgaacagaagacagaagttcttttagatcagcctgagatatggggttcaggccaaccaattaatccaagcatggagtcgccaaagttaacaaggccttttcccactggaacacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtgtccagaccttttagccctcccattcattcttccagccctcctccaatagcacccttagcgcgggctgaaagcacttcttcaatatcgtcaaccaattccttgagcgcagccaccactcccacagttggtaaaaattctctcctctcttttaatccgtttgtggttttgactggctattttttatgatctgaaatccccaaggccctgtgtttctggttgaaattgttttgctgtgtgttttgctactattacctgactcttcttttaaaaccaccttctcagcaaaggaggcaaagtgctttacctaagcaaatgaacaaataaaagaacattaacacctgtgttttgcaggaattttcttatgctgttccatacagagctattcaaaaaataagtaagaaatcgccaaggaaggtcttgtaatttagatattatttcttaaaataaaaatagtctcctttgaggggaaatgtttgtttaaattc

SEQ ID NO: 377207 - DNA, 400 bp, Homo sapiens
cgcccagggcctgcacagttggcgcccaccggcatcagcgtgaagggagctcctcgctggctgccgacggggctgcagggctcgctagccgctcacctgcgtgtgagcgcggagcccgcagtacccgccgtccgggctcagaggacgtgactccccgaccctgcgcccggcagtccccgggggccgtgcgcccggcccaggctcggaggtccagcccagcggcggctcaggctgcgcgcctggctcccagcctcagtttccccattggtaaagcattgacggtggttgcggacggcttctgcggacagagccttgggctccgacgtctgcgcgggtaccggcagcacccccaccccgaagggagggcgggacctggatctcgcgaccgctgccccaggtc

SEQ ID NO: 377208 - DNA, 1530 bp, Homo sapiens
  misc_feature (1466)..(1466): n is a, c, g, or t
  misc_feature (1469)..(1469): n is a, c, g, or t
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaattgcacacacaaacanaanaaaaaaaccgcgcgtttttgggggggcggaaaagggttgaaggcctggcatgttcccgccc

SEQ ID NO: 377209 - DNA, 2321 bp, Homo sapiens
  misc_feature (2134)..(2134): n is a, c, g, or t
gttactcggactaccccgatgcatacaccaaatgaatgagcctacagatgataggatgtttccggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377210 - DNA, 2300 bp, Homo sapiens
  misc_feature (9)..(10): n is a, c, g, or t
  misc_feature (2113)..(2113): n is a, c, g, or t
tccaggggnncacaactataggctaggtacgaggctgggtggtgggcgcgtcgactgcccagagtccgcggccggggcgcggggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377211 - DNA, 2442 bp, Homo sapiens
  misc_feature (2255)..(2255): n is a, c, g, or t
ggcaggccccgccccccgcccacgaggaagtggctgctgctccggcgcggagcccagagccggttcggcgcgtcgactgcccagagtccgcggccggggcgcgggagtgtcttgttctgttgcccaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377212 - DNA, 2250 bp, Homo sapiens
  misc_feature (20)..(20): n is a, c, g, or t
  misc_feature (2063)..(2063): n is a, c, g, or t
acccttttttgaagcccatngccggggcgcggggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377213 - DNA, 2551 bp, Homo sapiens
  misc_feature (2364)..(2364): n is a, c, g, or t
cgcccagggcctgcacagttggcgcccaccggcatcagcgtgaagggagctcctcgctggctgccgacggggctgcagggctcgctagccgctcacctgcgtgtgagcgcggagcccgcagtacccgccgtccgggctcagaggacgtgactccccgaccctgcgcccggcagtccccgggggccgtgcgcccggcccaggctcggaggtccagcccagcggcggctcaggctgcgcgcctggctcccagcctcagtttccccattggtaaagcattgacggtggttgcggacggcttctgcggacagagccttgggctccgacgtctgcgcgggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377214 - DNA, 2292 bp, Homo sapiens
  misc_feature (25)..(25): n is a, c, g, or t
  misc_feature (30)..(30): n is a, c, g, or t
  misc_feature (37)..(37): n is a, c, g, or t
  misc_feature (39)..(39): n is a, c, g, or t
  misc_feature (397)..(397): n is a, c, g, or t
  misc_feature (2105)..(2105): n is a, c, g, or t
tttttttaagaaaaaggccaggttnaatcngccaaananacaagttgaatttgtggagcatgttttgcctgggtgccacacagtaaacagaggtttcttgaaatgatcaatgggtagggctgaaaatgggcactggccctagccaggtgagtaggaaccgggcagggaagggcagagaggtgaggccctgaggtcagtcagacaggactgaccagggacaagccatgaccctcgaggacccaggggcacaggctcccagatgatagcccctctctgaatgagcacccaggcaacacagtccggggctgtgtgtagcaaacctgtcagcagctgcctcctgggacaaccacccccttacatgctatctatctaccagacaaatgaaagctcttctcgnacgcgtgggtcgacccacgcgtcgactgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377215 - DNA, 2513 bp, Homo sapiens
  misc_feature (2326)..(2326): n is a, c, g, or t
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactgatggagtctcactctgtcacccaggctggagtgcagtggcacgatcttggctcacggcagcctctgcctgccgggttcgagcagttctctgcctcagcctcccaagtagctgggattacaggcacctgctaccatgcccggataatttttatatttttagtagagatggggtttcaccatcttggccaggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377216 - DNA, 1698 bp, Homo sapiens
  misc_feature (9)..(9): n is a, c, g, or t
  misc_feature (19)..(19): n is a, c, g, or t
  misc_feature (1511)..(1511): n is a, c, g, or t
aaaacatangcagtagagnctgggttaggagccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377217 - DNA, 2190 bp, Homo sapiens
  misc_feature (2003)..(2003): n is a, c, g, or t
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcgccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377218 - DNA, 972 bp, Homo sapiens
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggccctcttgaaacattaccactgctggccccgtcccaaagcacagttgtgcttggggacggcggcaagggtaaagaaaaagtactgggaggattgtcagctgccgaaggtcggtctcgtagctcaggtgaac

SEQ ID NO: 377219 - DNA, 2111 bp, Homo sapiens
  misc_feature (1924)..(1924): n is a, c, g, or t
gcagaagttgcagtgagccaagggtgagccaccgagactccatctcaaaaacagaaaaaaaaagatatttacttcttgctcacattttatgtccagtgtgggtgttgtgaggtgctctgatggaagctgtccccagcatgctgtcccagatgccacgagggagccggaacctgcggaatcatgccctgggtcttaacatttctgcccacattttattggcaggtgcaatggcaaggccacgcctaatgcaaagggcgagagttcggggtgtgcggttcctccaggtgtccaggaagggcactgctctccctcccctccgcccacatctgtcaagtcccttttcacccctctgcaaacataatgggggtgccagggccaggtcaggcttgctttttgcctagaaaagcaaacagctgcaggggtctcccctagagcaggtgtaactggctgggcaggacagaaggcgcctgagctcccagggagtcccaacgctggccttgctgggggaggtggcagcccccagcatcacccccggttttgatacacctgcaattcgggcctccctcgctgtggcccgtctgtatccttgagctggcatctgcctcccgggcggccagacgcccgcctggccttccctccggcctcggtttcccctccgcggcgctccaatggcccccgccctccgcgcagggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377220 - DNA, 1119 bp, Homo sapiens
ggcaggccccgccccccgcccacgaggaagtggctgctgctccggcgcggagcccagagccggttcggcgcgtcgactgcccagagtccgcggccggggcgcgggaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcggccccgatgcttccggggctgtcacctatgaagcgcgcggggatgtgaagttcggggggaggggggaggtcctaacagagctcgaagtggttgaagggcgcgaggcttcagaactggg

SEQ ID NO: 377221 - DNA, 1442 bp, Homo sapiens
  misc_feature (25)..(25): n is a, c, g, or t
  misc_feature (30)..(30): n is a, c, g, or t
  misc_feature (37)..(37): n is a, c, g, or t
  misc_feature (39)..(39): n is a, c, g, or t
  misc_feature (397)..(397): n is a, c, g, or t
  misc_feature (1264)..(1264): n is a, c, g, or t
tttttttaagaaaaaggccaggttnaatcngccaaananacaagttgaatttgtggagcatgttttgcctgggtgccacacagtaaacagaggtttcttgaaatgatcaatgggtagggctgaaaatgggcactggccctagccaggtgagtaggaaccgggcagggaagggcagagaggtgaggccctgaggtcagtcagacaggactgaccagggacaagccatgaccctcgaggacccaggggcacaggctcccagatgatagcccctctctgaatgagcacccaggcaacacagtccggggctgtgtgtagcaaacctgtcagcagctgcctcctgggacaaccacccccttacatgctatctatctaccagacaaatgaaagctcttctcgnacgcgtgggtcgacccacgcgtcgacgcccagagtccgcggccggggcgcggggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggcccgactgtcccgtgntgtcctattacgcgcgcgggatgtgagcttcgcggcggtgacgtcctaggactccagtggttgcccggcttccactggaaaggccccgtggcgcggggcggcgcactcaaaagcatcggtcggggcgcctcccgtgtggggttgggggccccccattctcggggggggctgtggtttc

SEQ ID NO: 377222 - DNA, 1314 bp, Homo sapiens
  misc_feature (1127)..(1127): n is a, c, g, or t
tggtaaatcaagcagtcgtgcgttcctcggagctcgccttcttgtccaggttctggaagcgctcgcgggctagactcgctgcacaagaacagtgtcagcccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377223 - DNA, 1323 bp, Homo sapiens
  misc_feature (1136)..(1136): n is a, c, g, or t
cggccccttgacatctgggccttggtgctcactggggcacccgtcttcagggccgggattccaacccagctgacagactccaaaactgcaggttctctgccctctgctgtgctggggctgagatgggtgatcaggtccctgggagtggggtgcctgcaggacagctgagaaccagcctgtccgttctgcctccctgcagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377224 - DNA, 1042 bp, Homo sapiens
  misc_feature (855)..(855): n is a, c, g, or t
gcggccgctccaacatcagaatggtaactcgtattggtaccccagaaacattcagcaaagcaaccattagcctccctgatccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377225 - DNA, 904 bp, Homo sapiens
  misc_feature (9)..(9): n is a, c, g, or t
  misc_feature (19)..(19): n is a, c, g, or t
  misc_feature (840)..(840): n is a, c, g, or t
  misc_feature (843)..(843): n is a, c, g, or t
aaaacatangcagtagagnctgggttaggagccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaattgcacacacaaacanaanaaaaaaaccgcgcgtttttgggggggcggaaaagggttgaaggcctggcatgttcccgccc

SEQ ID NO: 377226 - DNA, 2324 bp, Homo sapiens
  misc_feature (2137)..(2137): n is a, c, g, or t
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377227 - DNA, 1329 bp, Homo sapiens
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaaggtgaggcttgcccctcctggcttcccgccatgcctcccaggtcaaccctttccccccatccccactccctggagatgacccccatccttcactcctgcagagatggcactgcatggggatgaggggtgg

SEQ ID NO: 377228 - DNA, 2422 bp, Homo sapiens
  misc_feature (2235)..(2235): n is a, c, g, or t
ggcaggccccgccccccgcccacgaggaagtggctgctgctccggcgcggagcccagagccggttcggcgcgtcgactgcccagagtccgcggccggggcgcgggaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377229 - DNA, 2667 bp, Homo sapiens
  misc_feature (25)..(25): n is a, c, g, or t
  misc_feature (30)..(30): n is a, c, g, or t
  misc_feature (37)..(37): n is a, c, g, or t
  misc_feature (39)..(39): n is a, c, g, or t
  misc_feature (397)..(397): n is a, c, g, or t
  misc_feature (2480)..(2480): n is a, c, g, or t
tttttttaagaaaaaggccaggttnaatcngccaaananacaagttgaatttgtggagcatgttttgcctgggtgccacacagtaaacagaggtttcttgaaatgatcaatgggtagggctgaaaatgggcactggccctagccaggtgagtaggaaccgggcagggaagggcagagaggtgaggccctgaggtcagtcagacaggactgaccagggacaagccatgaccctcgaggacccaggggcacaggctcccagatgatagcccctctctgaatgagcacccaggcaacacagtccggggctgtgtgtagcaaacctgtcagcagctgcctcctgggacaaccacccccttacatgctatctatctaccagacaaatgaaagctcttctcgnacgcgtgggtcgacccacgcgtcgacgcccagagtccgcggccggggcgcggggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377230 - DNA, 2311 bp, Homo sapiens
  misc_feature (2124)..(2124): n is a, c, g, or t
aatatattgataggtggcgggctggtgtgtcgatttacagtcgacgggggtcggcgtgtccattagtaccgggtgggggtgggcgaggatcaaagagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377231 - DNA, 2280 bp, Homo sapiens
  misc_feature (2093)..(2093): n is a, c, g, or t
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377232 - DNA, 1099 bp, Homo sapiens
  misc_feature (921)..(921): n is a, c, g, or t
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggcccgactgtcccgtgntgtcctattacgcgcgcgggatgtgagcttcgcggcggtgacgtcctaggactccagtggttgcccggcttccactggaaaggccccgtggcgcggggcggcgcactcaaaagcatcggtcggggcgcctcccgtgtggggttgggggccccccattctcggggggggctgtggtttc

SEQ ID NO: 377233 - DNA, 1667 bp, Homo sapiens
  misc_feature (1480)..(1480): n is a, c, g, or t
cttggattcgaacatcagttccccaaagggcatcttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377234 - DNA, 863 bp, Homo sapiens
  misc_feature (834)..(834): n is a, c, g, or t
  misc_feature (837)..(837): n is a, c, g, or t
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggcaacgcanctncctgacgaagaaacgcaacctccctg

SEQ ID NO: 377235 - DNA, 1445 bp, Homo sapiens
  misc_feature (1258)..(1258): n is a, c, g, or t
tttcattcatccaacaaactgttggagcagcggccacggctcctcgcgtggttgtccataaaaccccccggggataatatatttttcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaatgcccccaaagcactatgctggtcatgaactgcttcaaaatgtggaggtaataaaatgcaactgtgtgtaaaaaacaaaaaaaaaaaaaaagtaattatggacatgcttgcctatgtggaaggagaggttttttgttatttccttggggtcttgctaagttttccaggctgcactagaactcgtgggagcaatccttctgcctcagcctcccaagtagctgggactccagggagagattggtgtttgcacggccataggtagatagcttatttttactgcttgccaacaaaattgatcctgaagcccaacggccttatgccaaatggttccctccccactgctgtccatcctgggctgccactcccaaaactgccagtaccaggtgtcactgattgactagtcaaattcctggacaaaggggctacacactccaggctggttgtggaacttttgttttgagatggagttttgctcgtcacccaggctggagtgcagttgtgcgttctcagctcactgccacctctgccttcctgggatcaagcgattctcctgcctcagcctcccaagtagctgggattacaggcatacaccaccaagcctggttaatttacctctactttgcctatcccggtaggatcttttcagcctacatcaaggaggtggaggaacggccggnacccaccccgtggggctccaagatgccctttggggaactaatgttcgaatccagcagtagctgcggctgggtacatggcgtctgtttctcagccagcgggagccgcgtggcctgggtaagccacgacagcaccgtctacctggctgatgccgacaagaagatggcgtgagtcgaggccatccccagg

SEQ ID NO: 377236 - DNA, 1009 bp, Homo sapiens
  misc_feature (947)..(947): n is a, c, g, or t
ggcaggccccgccccccgcccacgaggaagtggctgctgctccggcgcggagcccagagccggttcggcgcgtcgactgcccagagtccgcggccggggcgcgggagtgtcttgttctgttgcccaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggcgngatctggcctgaaactaccacggtggctacctctcccaaaacgcctgggccggccccactgg

SEQ ID NO: 377237 - DNA, 742 bp, Homo sapiens
  misc_feature (661)..(661): n is a, c, g, or t
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcgatcttttcagcctacatcaaggaggtggaggaacggccggnacccacccccgttggggggctccccaaagaatgcccccttttgtgggggggaaaaactttggaattggttttccgggaaat

SEQ ID NO: 377238 - DNA, 489 bp, Homo sapiens
cgagtaagcgcccgaagaaacagctccactttcatgccagttaagctgtgtggcgacatggagccaaaatcctcatgcagaggcatttacccccaccccagccagccccagaccgcccccaacactggctggcgtcctcactgcttcccaagtcagctctgcccagggtcgtgccaaggcagctgtgatgggatgcgctcagccagagccggttgggacaggagtggtgccaagtgctccacgtgtggccacccaccgtcccctgcatccaccctaggaggcactgtgccattttattttattttattactttttttttttttttttgagacagagtatcgctctgtcccccaggctggagtgcagtggtgcgatctcggctcactgcaacctctgcctcctgggttcaagcgattctgctacctcagcctccagagcagctgggattataggctggagtacagtggcacgatctcggctcactgcaac

SEQ ID NO: 377239 - DNA, 531 bp, Homo sapiens
aatattcataatctactgtagaaataatttctttaaaatagaaccatttgatcacttagatcatgtatttacaaaataaagaatacattaaatacctttattctttattacttatattgcatagatatctacatatatataattctattagtcagaatgcagttttatatatctataaaaaaattaaactggtcatttatttccagctatgactaccattcaaaattaagacaataactgcatgatttaaaattgagggaatagtttggctgatttttacatactgcagtcacagcacaattctacattctagcaagaaaaacaaatattaaagaaaactgagaagttcttcagagtctctaatagtacagtagttaaccggcccactcattagtcagttgtttttactgtttctctccagtgttgtttcaaataaactttctaaatgtaaaatgatttcattaatcaactttaaaagtaaaatgaattgcacagaccaatgtctgaaatctgagtacacagcaaaaagca

SEQ ID NO: 377240 - DNA, 443 bp, Homo sapiens
ttcaaagcagcctccttgatattcatataagtaacagctcttcttctttgcctttgtgttttattctttacttacaaatacaaatgagccaacattaacatattaaataccagttggctgaacagaacacagtgaacaggaggtatacagagttggctaacaactatgagtcagcagtacatttgattctccgtatttgtgttttacaggggaaaatggagagctttcggtaatctaagtatgagtaaatggaggtcagtcaagggttgacctgcaggggctgcagaaagctgcctgaagataccatgattcagcccattcttaatggagacagagatgttgatggaagaacagtgagcacaggaggaagttgataaactagtctgaaaatgctgctatttcaaatctgtgtctgcagttaaacatccaaaaatttggttgca

SEQ ID NO: 377241 - DNA, 546 bp, Homo sapiens
gtctcaaaaaaaaaaaaatagaaagaaaatgaaatttgttttgagtaataaaaattaaaagtcatggctggacgcagtggctcatacctgtaatcccagcacttttggaggctgaggcaggaggattgcttgcggccaggagttggagaccagcctggccaacatggtgaaacccgatctctactaaaaatacaaaattagccaggtgtagtggtacatgcctgtaatcccagctacttgggaggctgaggcaggagaatcacttgaacacagaatgtggaggttgcattgagccaagatcaagccactgcagtccagcctgggcaacagagtgagactccatctcaataaataaataagtaataaagtaaaaaataaaaaaccttgattctttaagatgaaaaagttcttgagattggttgcacaacaatgtgagtatacttggctgggtgtggtgacacatacctataatcccagcactttgggaggctgaggcaggtggactgttgagcccaggagttcgaaaccagcctgggcaacatggca

SEQ ID NO: 377242 - DNA, 1576 bp, Homo sapiens
  misc_feature (1575)..(1576): n is a, c, g, or t
gcctgagttcgccagtggtccaggagccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaaggagtctatgaactagctgtttttcagatgaaacctggtgggccagctctgtggggtgatgcatttgaaagagcaattaatgcccatgtcaatttaggctacacaaaagtagttggtgttttccacacagaatatggagaactcaacagagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggtaagttaattagttaatttgctgtgcttcttgcatttttgaaagttacatattctccactgctttaagaaataattcagttcactttcaccttggcatttcagtatctgttacacattagaagtagttgtcactatttcatcatcttggtttttcatttgttttagaatacctcttctgtattttgataactcattgctttatagcattttcttttactcaaataaggattttacatttccttttcctgagattttaaaaaaatttgcttagtaaaggttattttgtgatataaaatgggatttataaaaatattagattgtttatttctttactgtggaaaagtagaatgtcatctgtattaattattgcttttacattcattgattattagtcattctaacttggaaaataatgcaattgggtcacagtgttaaaaatctagaaaagacttgttggtttatatgctgaaattgttcatttataattaattttactaatttctccttagtttggatcactaacagagatcttgggacatttatttgttttaaagaaatatttatggttatggaaacgcttgccctaataaaaatcctgcatattcattgtttttttnn

SEQ ID NO: 377243 - DNA, 1599 bp, Homo sapiens
gcctgagttcgccagtggtccaggagccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaaggagtctatgaactagctgtttttcagatgaaacctggtgggccagctctgtggggtgatgcatttgaaagagcaattaatgcccatgtcaatttaggctacacaaaagtagttggtgttttccacacagaatatggagaactcaacagagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccaaatgtt

SEQ ID NO: 377244 - DNA, 1050 bp, Homo sapiens
taatgttttacttatatatgatttgttaatgtatgtcttttcccactagaaaccgaattctatgacagcaagggtttttgttttcattattgtcatattacctgtgcctggcatgtgataagccctaagtacttgttgactgaattaacatatgagatctgtgagtctgaaaaaagaagtacatcattccttcacatgtcattttgagccactgttaacagattacataactgttattggaagtgcctcactactccatttggaaagtattcctggaatacacgatgaatgactcagtagaagttctggctatgggggagtgccatcaataaataaaaataataccattgtctgttggttataagttgctgtcacagactatgaaggtatttgaattgtattttcaggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccaaatgtt

SEQ ID NO: 377245 - DNA, 1471 bp, Homo sapiens
gcctgagttcgccagtggtccaggagccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcagataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaaggagtctatgaactagctgtttttcagatgaaacctggtgggccagctctgtggggtgatgcatttgaaagagcaattaatgcccatgtcaatttaggctacacaaaagtagttggtgttttccacacagaatatggagaactcaacagaggttcacggggtacatgtgaagatttgttacttaggtaaacccatgtcatgggggtttgttgtacagattatttaatcactcagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccaaatgtt

SEQ ID NO: 377246 - DNA, 1650 bp, Homo sapiens
ttctgattcctacatcgttttcaccactgaaatagttttctactgaaatacaaaacatttcattaactgctataggatctgtctgctaatggtgcttaaattctcccaagaggttctcacttttatttgaaggaggtgtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaaggagtctatgaactagctgtttttcagatgaaacctggtgggccagctctgtggggtgatgcatttgaaagagcaattaatgcccatgtcaatttaggctacacaaaagtagttggtgttttccacacagaatatggagaactcaacagaggttcacggggtacatgtgaagatttgttacttaggtaaacccatgtcatgggggtttgttgtacagattatttaatcactcagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccaaatgtt

SEQ ID NO: 377247 - DNA, 738 bp, Homo sapiens
catcttaatttcatttatgttaactttgattcaaagtgtaccttgacctaatcacccaccaccaaggaaaaatagtctttctctataaatcaaatgcttccattgataagaatcgttaacatatactgagtactaactaaggtgccaaacaccattctaagctcttttcatgtactaattcatttaatcctcacaacaacactggaggtagatgttatactattttcttcacagaataagaaactgaggcacagaaagattgaataacgaacctaattcacacaacttcctaagaaagtcttagagcctataaagcccattctatgtcaattaagttagttttttacatttcaactccccttttagaccatgagtaacttgagagcagttgtcacatatatttatgttggcatctccagcgacataataacatggggttcccatatggccttgcacgtttgctgaactgagtaaaattcaagtaaaaatatgggcgattttaaataaaaaaacattttcttaactattttcctcccatagataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaagaaggtgagttcttccctcttagactatgagttttaatga

SEQ ID NO: 377248 - DNA, 1635 bp, Homo sapiens
  misc_feature (1634)..(1635): n is a, c, g, or t
gcctgagttcgccagtggtccaggagccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaaggagtctatgaactagctgtttttcagatgaaacctggtgggccagctctgtggggtgatgcatttgaaagagcaattaatgcccatgtcaatttaggctacacaaaagtagttggtgttttccacacagaatatggagaactcaacagagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggtaagttaattagttaatttgctgtgcttcttgcatttttgaaagttacatattctccactgctttaagaaataattcagttcactttcaccttggcatttcagtatctgttacacattagaagtagttgtcactatttcatcatcttggtttttcatttgttttagaatacctcttctgtattttgataactcattgctttatagcattttcttttactcaaataaggattttacatttccttgcctgacagtatttttgaattatttatataaaatatctatcttttcatcatgtctatagttcctgagattttaaaaaaatttgcttagtaaaggttattttgtgatataaaatgggatttataaaaatattagattgtttatttctttactgtggaaaagtagaatgtcatctgtattaattattgcttttacattcattgattattagtcattctaacttggaaaataatgcaattgggtcacagtgttaaaaatctagaaaagacttgttggtttatatgctgaaattgttcatttataattaattttactaatttctccttagtttggatcactaacagagatcttgggacatttatttgttttaaagaaatatttatggttatggaaacgcttgccctaataaaaatcctgcatattcattgtttttttnn

SEQ ID NO: 377249 - DNA, 1628 bp, Homo sapiens
gcctgagttcgccagtggtccaggagccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaaggagtctatgaactagctgtttttcagatgaaacctggtgggccagctctgtggggtgatgcatttgaaagagcaattaatgcccatgtcaatttaggctacacaaaagtagttggtgttttccacacagaatatggagaactcaacagaggttcacggggtacatgtgaagatttgttacttaggtaaacccatgtcatgggggtttgttgtacagattatttaatcactcagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccaaatgtt

SEQ ID NO: 377250 - DNA, 1554 bp, Homo sapiens
gcctgagttcgccagtggtccaggagccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaagctctgtggggtgatgcatttgaaagagcaattaatgcccatgtcaatttaggctacacaaaagtagttggtgttttccacacagaatatggagaactcaacagagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccaaatgtt

SEQ ID NO: 377251 - DNA, 2581 bp, Homo sapiens
tcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgcttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagc

SEQ ID NO: 377252 - DNA, 2635 bp, Homo sapiens
tcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgcttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagcaaaaaccaatatattaggtccacccggccgccaatttagtagtaattgtcgacc

SEQ ID NO: 377253 - DNA, 2602 bp, Homo sapiens
tcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgcttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttctaattactaccttttattctaatgtgaaccctggccctgaaagctgataaccagcttggctgagccgagggacatgcacccggttgatttctgactggcccggacatccaagcgctgtctgcatgagtgctgatccctcccttaccttttaatctcgc

SEQ ID NO: 377254 - DNA, 1798 bp, Homo sapiens
tcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgcttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagtggcgctgccctatactccctctacatatttaccacaacacaatgaggctagtgacgggatgaggctagtgcgctg

SEQ ID NO: 377255 - DNA, 2605 bp, Homo sapiens
tcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgcttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 377256 - DNA, 412 bp, Homo sapiens
gctatggtaagacgtgcttgcttcccctttgccatctgccatgaatataagtttcccgaggcctcctagtcatgctttctattaagcctgcagaactgtgagtcaattaaacctctttttgtcataaattgcccagtctcaggtagttttttatagcagtgtgaaaacagactaatacattggaattataggtctgtgccaccacacctggctaatattttggtatttttttgtagagatagggtctcactatgttgcccaggctggtataattgaatttttaacattaatcttgtatttgcaattttgtaaaaaccacttatgagttctaacagcttttcttgtggattttgctagattttctatatattcaggatttgttatctatgaataaagacagttttacttcctt

SEQ ID NO: 377257 - DNA, 348 bp, Homo sapiens
ctcccgggtctcagattccccccttctcaattagagatggttcttccctcccagccatgcagaattgctgtgcacacaaaggatgagtaagtatgtcaaaggctttgcaaagtatgcaaaactaaagaatcgtaaggtgttcctaacatggagaaactgcaaccacttgactcagcatttgctcttgcagggtctcctgacaaactggcagagatccaaaacaagaatgagtgagaaggccccatgaggttattcgactccttatacttgagcttggcagcttctggcactaagacgcctgcgcatttcttcctgggtacatttcctctagttggtccagatgagagg

SEQ ID NO: 377258 - DNA, 214 bp, Homo sapiens
caactctgcctcccctactgcacagtgggcttctcaagcaccatgaccttgtctttttctacttaagttcccggtaccccaacagtgccaggtttatgataaattttcagtgaatatcaatacgttgaatgaaccaagttttctttttcttactgccctgggtcatatacagagatacacacagaaaaatgtgtttttgaaaagaaaaagcaca

SEQ ID NO: 377259 - DNA, 1544 bp, Homo sapiens
ccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcgggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctgatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcgcctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagccagccacgctggtctccccaaggctggggtgagggtggctgggtgcccaggctggtaccatcacc

SEQ ID NO: 377260 - DNA, 1627 bp, Homo sapiens
ccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcgggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcgcctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagca

SEQ ID NO: 377261 - DNA, 1584 bp, Homo sapiens
ccgggaagccggagtctagagctccgggcgcggggaggcgcggccatggcaggtacggcgggcccagcggggcggaggcgcggggcgcggggctgcaggggcgcggggctgcagagccgtggggcgagcggcctccctgcagcctctcgctgtccgcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcgggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctgatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcgcctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagca

SEQ ID NO: 377262 - DNA, 1364 bp, Homo sapiens
ccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcgggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagccagccacgctggtctccccaaggctggggtgagggtggctgggtgcccaggctggtaccatcacc

SEQ ID NO: 377263 - DNA, 1160 bp, Homo sapiens
ccgggaagccggagtctagagctccgggcgcggggaggcgcggccatggcaggtacggcgggcccagcggggcggaggcgcggggcgcggggctgcaggggcgcggggctgcagagccgtggggcgagcggcctccctgcagcctctcgctgtccgcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcgggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggtgtgtggcccaccctgtctaggggcaaggggctccggagcccagtcggtgggcagcgggcggggctcccctgcgtatcagctccatgagagctggggccttgtctgctttgtttgctactggtacactgtgggtgctcaataaatgtatgaaggagggtgc

SEQ ID NO: 377264 - DNA, 848 bp, Homo sapiens
gtgccactgccctccagcctgggcgacagagcaagactgagtctcaaagagaatgagggcacaggctggctccagtgttggggcagggccacagcctgagccagtcttttgctgttcctcccttccccaggacttccacagtcacctgacacggagtgaggtcgtgggttacctggggggccgctgggacgtcaacagccagagtgggtatccagggccgggtgggcgggggcgttggaggaccggggtcacggggtcacagctgcccctccccacagtgctgacggtgctcagagccttcccttgtcggagccggctcggggacgcagagactgcagctgccatcgaagaggaggtgaggggctacctgggaggtggcattctggggagggttgggaagggacatagctgtcctggcgactgcccagtggctggcagtgttcttcacccttcaccatggggtcccaggtgaagggtgaagaacactgctttttttttttttttttgagacggagtctcgctctgtcacccaggctagagtgcagtggtgcgatctcagctccctgcaagctccgcctcccgggttcacgccattctcctgcctcagcctcccagtgaaaaaaaatttcttcttcgtaaataagagtctcactctgtaactcaggctggagtgcagtggtgtgatcacagctccctgcagcctcaacctcccatgctcaagcgatcctcctgcttcagcactgggattataggcatgcaccaccacacccagtggccacctaatttgttctaacttgggctggggagggactgaccctgcctttttctctcccagaggccacaacccc

SEQ ID NO: 377265 - DNA, 624 bp, Homo sapiens
  misc_feature (373)..(373): n is a, c, g, or t
  misc_feature (382)..(382): n is a, c, g, or t
  misc_feature (424)..(424): n is a, c, g, or t
  misc_feature (426)..(426): n is a, c, g, or t
  misc_feature (432)..(432): n is a, c, g, or t
  misc_feature (463)..(463): n is a, c, g, or t
  misc_feature (559)..(559): n is a, c, g, or t
  misc_feature (618)..(618): n is a, c, g, or t
ccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagtactgggccactgcagcagacgaangatcatgtngcagagacgggcagacttcactcaccacgctcgtcaccactnanactgtnactgcagatggtgtgtgctttcatacagcanatgacataagcactgctcgctcacacgcaaactccagctgctcacaaccacataggagagcagattagcacagcagcagcagagtctgcagggttnacacagacacatagcacacatgggcacacatcacactgccacgcaccaaaccagtatgntgtaac

SEQ ID NO: 377266 - DNA, 1734 bp, Homo sapiens
ccgggaagccggagtctagagctccgggcgcggggaggcgcggccatggcaggtacggcgggcccagcggggcggaggcgcggggcgcggggctgcaggggcgcggggctgcagagccgtggggcgagcggcctccctgcagcctctcgctgtccgcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcgggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcgcctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagca

SEQ ID NO: 377267 - DNA, 1604 bp, Homo sapiens
ccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcgggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcgcctttctgggtgatgcctcctcccgagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagccagccacgctggtctccccaaggctggggtgagggtggctgggtgcccaggctggtaccatcacc

SEQ ID NO: 377268 - DNA, 1534 bp, Homo sapiens
ccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcgggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggaggtgaggggctacctgggaggtggcattctggggagggttgggaagggacatagctgtcctggcgactgcccagtggctggcagtgttcttcacccttcaccatggggtcccaggtgaagggtgaagaacactgctttttttttttttttttgagacggagtctcgctctgtcacccaggctagagtgcagtggtgcgatctcagctccctgcaagctccgcctcccgggttcacgccattctcctgcctcagcctcccagtgaaaaaaaatttcttcttcgtaaataagagtctcactctgtaactcaggctggagtgcagtggtgtgatcacagctccctgcagcctcaacctcccatgctcaagcgatcctcctgcttcagcactgggattataggcatgcaccaccacacccagtggccacctaatttgttctaacttgggctggggagggactgaccctgcctttttctctcccagaggccacaacccc

SEQ ID NO: 377269 - DNA, 309 bp, Homo sapiens
actctctccctcccccccacgcgccccctccgcctcccgctccacaacccccctaatcaccccgtcctactaatcgtggtactctttagtgtttgctagcttcccttttaaattgataaatggacatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaa

SEQ ID NO: 377270 - DNA, 3975 bp, Homo sapiens
tagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctcaaagtgcagctacaccagcactctccaatcctcacctcactgctgtgctccagaacaagtttggcctgtcactgctcctcatcctcctgagccgtggtgaagacctacagagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaa

SEQ ID NO: 377271 - DNA, 2570 bp, Homo sapiens
gggtcgcgcgcaggggggctgcgatcggccgaggttatctagagtcaccaaagccgcagggccccgcaaaatgatgatgctgtgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctcaaagtgcagctacaccagcactctccaatcctcacctcactgctgtgctccagaacaagtttggcctgtcactgctcctcatcctcctgagccgtggtgaagacctacagagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaa

SEQ ID NO: 377272 - DNA, 4016 bp, Homo sapiens
  misc_feature (3675)..(3675): n is a, c, g, or t
  misc_feature (3679)..(3679): n is a, c, g, or t
tagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctcaaagtgcagctacaccagcactctccaatcctcacctcactgctgtgctccagaacaagtttggcctgtcactgctcctcatcctcctgagccgtggtgaagacctacagagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaaaaaaaagngggnaaaattttcccccccttttcccctttggggatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaa

SEQ ID NO: 377273 - DNA, 1713 bp, Homo sapiens
ctccgtacccccaaggaaccatccagccagggctggcttcacccgcaattcaggcttcagaggggccgatgcaaatacagacactgcccaacatgagatctggggctgcttcacaaacttaaggctctaaaatccatccacgttggccctgcctgcgaacctatgaataggttcgcaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaa

SEQ ID NO: 377274 - DNA, 2170 bp, Homo sapiens
tagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctcaaagtgcagctacaccagcactctccaatcctcacctcactgctgtgctccagaacaagtttggcctgtcactgctcctcatcctcctgagccgtggtgaagacctacagagttcagaccctgctacagaatcaacacaaaataatcagtgacagaggtgatgttcattgcaacacgtctcttaaggatcgg

SEQ ID NO: 377275 - DNA, 1976 bp, Homo sapiens
tagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgtaagtgtcaacacaattgtctgtttaagaacgtctgatttgtgaccacttcttttggggtcaccatggaatgagatcaggcatggtagagttgtttgtagtctaacccggggcctcccacctcgtcatgcattctagttttccacagatgtgctgcagtattaacaccttcatttctaaggcagccaggcagggactagggtggcaggagtctttggattgggtagctctggctgcaaacagcatgtatttactccagtttgatgttaaaaaaattatcattttctatgtgttttaagattttcaggaagaggatcagaaagaataattatggggcactaggcttagtacctgggtgatgaaagaatttgtacaacccccatgacataagtttacctatgtaacaaacacatgtaccctataacctgcacgtgtaccattgaacctaaaattaacgtttaaga

SEQ ID NO: 377276 - DNA, 375 bp, Homo sapiens
acaattaaatatttgtaaaattttcttttgaggtacttagcatcttgcactattcactatcagtatatttctagagctgaacttgtgttactgtcactggcataaattatttgatggtaaacaacagtcgtgttctgtgcttgtgttacaactgaaatcatcttctcgtggtagaattactttgaaaaactggagaaactgtcagctgctgaagaaatacaaggtgatggccctaagaaggagcgcaccaagcttatcacccctcaggtggccaaactggagcacgcctataagccaggtaaggtcctcataagaaaaatgcccataataaaagaaatttgagaagctgctgatgtgattaaatatagacaagtg

SEQ ID NO: 377277 - DNA, 440 bp, Homo sapiens
gaatggttgcccgtattcttcctttcctctccacagagcaagcagctgacattctcatgacaacagccaggaacctccctttccttatcaagaaggatgcacaagatgaggtgactatgcaagatgggacatctttcttttgagtctttataagtgataagatttctagaatgcaaacttattttcctctcctcttcccttttgtatttttgtctaatctttggctgtgtgatttgattatttaaaacaaaacctttagtatttcaggcctatatttttaatcccatatttgatggaacagactatgtttctaaacatgagaaaaacaacaattccctcttacttgacatagttgtaaagatgtggtctgtatcagaattacttgcgtagataattcaactccaccccaaactgctgaatcagaatttacagaaggatta

SEQ ID NO: 377278 - DNA, 4289 bp, Homo sapiens
tagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctcaaagtgcagctacaccagcactctccaatcctcacctcactgctgtgctccagaacaagtttggcctgtcactgctcctcatcctcctgagccgtggtgaagacctacagagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaaaaaaaaaaaaaaaaaaaatttgtgggcgggcttgggcctgggaaagagttttaaaaacaatcgggtggggggcgccgcggcccccgagcaaggtcaacagtagaccttggcgcaagaggctggtcccaaagagaaaccggggcaacagaagaaggtcgttgggagttctctcacgcaaaaaaaaagcggcccggggggaaaaccgaaggcgtcctggacgaaatcccaagagggaggccgagaaggccatacaggggtccaacaacagggattccaaagagagcagaataaatcgagagcgacggggaggacac

SEQ ID NO: 377279 - DNA, 2139 bp, Homo sapiens
gaccgcttcatcttacctgcccggctcggctccccagcctgtagacttcctattttctgcccacagccagcgtcatgttctccaccatcctcctcagatactatctttgaccccttggtgctcctaccctttcctgatgccactccacctacgccttacatcagtcaccaaatctcaccatcacagtctgaccaaaagcggaaacttctcatctgactcctctgatgcacagagatcgagctgagccctagagataggtagtgacttgctggggtcacatggtgatttcatggcgagactggaccacagcccaggcccctgggatccactcctaccctgactgcccccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaa

SEQ ID NO: 377280 - DNA, 2779 bp, Homo sapiens
tagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgagtgagtatcaccagccttttgcgacagctaatgaacctacctcaaagtgcagctacaccagcactctccaatcctcacctcactgctgtgctccagaacaaggtgatcttgcccttttaactccttgaactttgtgaaatgtcttaatttgcgttatagattaaaataatggctgctgtatctctagcaacttgggaaaaaggcttctttcagtcaagagttacattaagctcctagtaaccggctagaaataacagtgttttcaacaaaatgggattttatgtgtctagtgtgaaataaatttgatttagtagctcgacagagtcatcagggatccaggctttttcactttttttcctctgccattcttaccagtggcttccatgttcattattcctcatggtccaagatggctgtggaattcatgattcagctttacatcaagaaggacaggtggatgtggagggcaaaaagatgtggaccagctgtccatcttccttattgagaccttttccaggagttctaaccagaaacttctacttactgttaatagccaggacattgtcacatggccacacctaagtgcagggaaggctggaaaatatcttttagtttatgccattgtcatgacacataagagttctgataatgggtaggaaggcatattaggcaattagcagtctctgtcataacactatgaatagtagaatcatccatttcatattttatttgcatcaagtttaaagattcagagattcctaggggaaacataatatgaaataaagaatatgaatttttagtccttccctgctactgtctagctttgtgaccttggacagatgatatcacattgctgaatcagtttcctggtctataagatggaggtgatgatgtagact

SEQ ID NO: 377281 - DNA, 330 bp, Homo sapiens
catctgcaagtattaataagagaaactccagccaaaaatggcctaagtgtaagaatccagagccagctgcagtggtgcgcacctgaaatcccagctactcaggagactgagtcaggaggattggatcatttgagcccaggagtttgagaccagccaggggaatgtagtgagaccctgtctcaaaaaagaaaaggaaaggttgtgggctcagtggctcacgcctgtaataatcctagcactttgggaggtctgaactcccagccaacatggtaaaacctcgtctctatgaaaaatacaaaaaaattagccaggtgtggtggtgcatacctg

SEQ ID NO: 377282 - DNA, 550 bp, Homo sapiens
gcaatctttgccacaacttcacattggatagggaaaatgaaaagaacattgtgtttcttttgtcttgtgatagtgattaatatctagctattctttattctcaggctcactttaatatttgagaaatcagagttatgctctacaaataatatataacattgatatcgtaaggtttctatttttctggattttgttttctccttgaaaggctgttatcgagttgatggtgtggtttaccatcagttgcatcttagaaataaaatatttgggccaggtgcagtgactcgtgcttgtaatcccagcactttgggagtccgaggctgacagattgcttgagctcaggagttcgaaaccagactgggcaacatagcaagacccagtctctgcaaaaaaaaaaaaaattagctgggcatggttgtatgctcctgtagtaccccctactcaggaggctgaggtgaaagaatcacttgagcccaggaggcagaggttgcagtcaactgagatctcaacactgcactccagcctgggtgacagaggcagaccctatctc

SEQ ID NO: 377283 - DNA, 418 bp, Homo sapiens
tgaagactgggaatatggggggatttaaagattgacgtaaatcatccaggatgctttttgtccaagagtagaagtgctgatgatgtctaactggtcttgatttcgtttgaaaaggtatccctaccattagtatctgtagcaagtggcatggcacgttgccagcattcatggacttgcaaggcagccagaaaatgccggggtaaatttggagttggaagaggtttaattttttttattagaaaggggtagagaagagagaagtcatttccatctagttccacacagtttcctctccctctctcgctctctctcactctctctgcctctctccatttaaaatttatttcaaagatgggttttggaaggcaattttgattatgtaggggatatgtagctatgtctgtcaaagacaaaaaaa

SEQ ID NO: 377284 - DNA, 812 bp, Homo sapiens
aacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcttaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctacta

SEQ ID NO: 377285 - DNA, 7649 bp, Homo sapiens
cagacatcacaaaaaacattacgcagtacaggcccgctgctgatcggccgaggagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggactgggctctcatctcagtgccagtggcactgaatgttacatcacgtcagatatgttctatgtggaagtgcagttagatcctgcaggacagctttgtgatgtaaaagtggctcaccatggggagaatcctgtgagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacatcaaccaacacctttccggggggtcccattgccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttctcaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaactcctccatcctctaaagccaagtcccctatcagttcaggttctggtggttctcatatgtctggaactagttcaagctctggcatgaagtcatcttcagggttaggatcctcaggctcgttgtcccagaaaactcccccatcatctaattcctgtacggcatcttcctcctccttttcctcaagtggctcttccatgtcatcctctcagaaccagcatgggagttctaaaggaaaatctcccagcagaaacaagaagccgtccttgacagctgtcatagataaactgaagcatggggttgtcaccagtggccctgggggtgaagacccactggacggccagatgggggtgagcacaaattcttccagccatcctatgtcctccaaacataacatgtcaggaggagagtttcagggcaagcgtgagaaaagtgataaagacaaatcaaaggtttccacctccgggagttcagtggattcttctaagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaaggaaaagaagaaagtaaaagacaaagatagggaccgagaccgggacaaagaccgagacaagaaaaaatctcatagcatcaagccagagagttggtccaaatcacccatctcttcagaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagtttataggcaaaccaccataaggggtgagtcagacaggtctgatttggttaagaatcctaaatggcatggctttgacatcaagctgggtgaattagaaaggcatatccagaccctattaaagaaaccacagggtttgattctggttaccaggaagtcttctttgttcctgtgccagaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaatagggttcagagatcataggaatattaggagttacctctctgtggaggtattgacttgtaatctcattttcctttcaaaaaaaaaaaaaaaagctaaggtggcttgttgggatgtaaacatgttttcagatgcagtaaggtttagtgtaggacagccttcctgacccagtggcatgaaaaccattacaggattaatagttctcctacttccacaatgtgccaaaagtctgcatcccagcattttgtttgcaggagaactgatgccattcctaagagctggactcactgtttctcttcatcacaaggagaaggagtccaaactttaatcactccactgtatgctccctgagataaaacagtaaaaaatccgcagccatagttcacttaaaacaatttcaagctcacttttgaagtaatgggggcctggaatgctaggtgagcatgaagataaacccttgctactatgtagcaacccaattggacctttttggagaaataggtctgagtctggattctgggggacatcaataagagcccttcacataaaaatatagaaatccaggagactgtttcgagtgcaacagaagttctcagtatttggagggtcctctcaaaaattctgcggccttactttgatattgacacctgcactgtgccattcctgattattccattcaggatctgtatcagcgggatggggcatggtccccagcacaactcttctgggttaaaaaaaaaaagccaggtgattcctttgtgtgttatgtcgtaagtggagtgacttcatcatatatggaagaagatttctatattcagctttttctgcaggttggagtcagcatagagttggaaaatcagctttggctttctttcctgtctcatttcctctagtgttctcctttttattgtcatcagctctcaacaactctgccacttttgtgtcccaaggtaataagatgtaggaaacaaaacattgtaaagtggagcaagaaaagttatcaattaaccacatcagagtcaaatgtcttgggtgacactaaggaggatatgggcaggtgataccagagtgctttatcttgtgatgttgatacagtagcagcctctcagacattcagccaggttggatttctcatgagtttgtcacctagttttgaatcctatcccgttggtttctgcaggaaaaaaaaaaaaatttatgtggtttttaaaatttgttctgagtggggagaatcttagggggaatgtactgaatagtatcatgggctcagctcccccatgcagggccaacaaataccaaaatgagtaaactgggaagcttttctctctttctgtcttcatcccagatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtga

SEQ ID NO: 377286 - DNA, 7340 bp, Homo sapiens
cagacatcacaaaaaacattacgcagtacaggcccgctgctgatcggccgaggagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacatcaaccaacacctttccggggggtcccattgccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttctcaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaactcctccatcctctaaagccaagtcccctatcagttcaggttctggtggttctcatatgtctggaactagttcaagctctggcatgaagtcatcttcagggttaggatcctcaggctcgttgtcccagaaaactcccccatcatctaattcctgtacggcatcttcctcctccttttcctcaagtggctcttccatgtcatcctctcagaaccagcatgggagttctaaaggaaaatctcccagcagaaacaagaagccgtccttgacagctgtcatagataaactgaagcatggggttgtcaccagtggccctgggggtgaagacccactggacggccagatgggggtgagcacaaattcttccagccatcctatgtcctccaaacataacatgtcaggaggagagtttcagggcaagcgtgagaaaagtgataaagacaaatcaaaggtttccacctccgggagttcagtggattcttctaagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaaggaaaagaagaaagtaaaagacaaagatagggaccgagaccgggacaaagaccgagacaagaaaaaatctcatagcatcaagccagagagttggtccaaatcacccatctcttcagaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagtttataggcaaaccaccataaggggtgagtcagacaggtctgatttggttaagaatcctaaatggcatggctttgacatcaagctgggtgaattagaaaggcatatccagaccctattaaagaaaccacagggtttgattctggttaccaggaagtcttctttgttcctgtgccagaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaatagggttcagagatcataggaatattaggagttacctctctgtggaggtattgacttgtaatctcattttcctttcaaaaaaaaaaaaaaaagctaaggtggcttgttgggatgtaaacatgttttcagatgcagtaaggtttagtgtaggacagccttcctgacccagtggcatgaaaaccattacaggattaatagttctcctacttccacaatgtgccaaaagtctgcatcccagcattttgtttgcaggagaactgatgccattcctaagagctggactcactgtttctcttcatcacaaggagaaggagtccaaactttaatcactccactgtatgctccctgagataaaacagtaaaaaatccgcagccatagttcacttaaaacaatttcaagctcacttttgaagtaatgggggcctggaatgctaggtgagcatgaagataaacccttgctactatgtagcaacccaattggacctttttggagaaataggtctgagtctggattctgggggacatcaataagagcccttcacataaaaatatagaaatccaggagactgtttcgagtgcaacagaagttctcagtatttggagggtcctctcaaaaattctgcggccttactttgatattgacacctgcactgtgccattcctgattattccattcaggatctgtatcagcgggatggggcatggtccccagcacaactcttctgggttaaaaaaaaaaagccaggtgattcctttgtgtgttatgtcgtaagtggagtgacttcatcatatatggaagaagatttctatattcagctttttctgcaggttggagtcagcatagagttggaaaatcagctttggctttctttcctgtctcatttcctctagtgttctcctttttattgtcatcagctctcaacaactctgccacttttgtgtcccaaggtaataagatgtaggaaacaaaacattgtaaagtggagcaagaaaagttatcaattaaccacatcagagtcaaatgtcttgggtgacactaaggaggatatgggcaggtgataccagagtgctttatcttgtgatgttgatacagtagcagcctctcagacattcagccaggttggatttctcatgagtttgtcacctagttttgaatcctatcccgttggtttctgcaggaaaaaaaaaaaaatttatgtggtttttaaaatttgttctgagtggggagaatcttagggggaatgtactgaatagtatcatgggctcagctcccccatgcagggccaacaaataccaaaatgagtaaactgggaagcttttctctctttctgtcttcatcccagatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtga

SEQ ID NO: 377287 - DNA, 1917 bp, Homo sapiens
cagacatcacaaaaaacattacgcagtacaggcccgctgctgatcggccgaggagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggactgggctctcatctcagtgccagtggcactgaatgttacatcacgtcagatatgttctatgtggaagtgcagttagatcctgcaggacagctttgtgatgtaaaagtggctcaccatggggagaatcctgtgagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatgcaattccacagggggccggtaccgagctcgatta

SEQ ID NO: 377288 - DNA, 554 bp, Homo sapiens
cagacatcacaaaaaacattacgcagtacaggcccgctgctgatcggccgaggagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgagggtaagtgactgtaggggaaaggagggggcgggacacaactgggggagccagtttgtgagaggaggttcttgcagatgtcccatgggggccactttaggggcatagagtccaggagagggaatgtgtattagttttagattgtcactataccctccttggtgattatagagcttcgactttagggcgatggggactctcaacttctgtgaagatttcatgctcgactagggcacttttggcctaaagtggtgggagacggggcaaatgaatacaaaatcagcttacatctcg

SEQ ID NO: 377289 - DNA, 522 bp, Homo sapiens
  misc_feature (200)..(200): n is a, c, g, or t
  misc_feature (234)..(234): n is a, c, g, or t
tccttctcgggttccaagcaaattctcctgccctcaacccttccaagcagctgggattaacaggtgccctgccacccacgctccgctaatttttgtagttttagtaaagatggggttttgcaatgttggcaagcccggtctcaaactcctgacctcaggtgatctgcccgcctcagcctcccaaggtgctgggatgacanggctgagccaccccgcttggtcatatttttcaanctattaactcatgttcttctcatctactctccggccaaactgaagactaaaatgtacttggctctccaatccttagaacaagatctttctaaaatggcaattatgtactggaaagactgctaaaaccttaattctacatgatcccttgagtttttctctggggagattagggtcctattttatacatctctattaagcctgtatgataatatgtcctttctcttccaaaatgatgattgtatttgaacttctgagtatcagtatcgctaagtcgttgttacacattct

SEQ ID NO: 377290 - DNA, 1289 bp, Homo sapiens
ccacgcgtcgcggacgcgtgggtcgcccacgcgtccgccacgcgtccgagggtcctctcaaaaattctgcggccttactttgatattgacacctgcactgtgccattcctgattattccattcaggatctgtatcagcgggatggggcatggtccccagcacaactcttctgggttaaaaaaaaaaagccaggtgattcctttgtgtgttatgtcgtaagtggagtgacttcatcatatatggaagaagatttctatattcagctttttctgcaggttggagtcagcatagagttggaaaatcagctttggctttctttcctgtctcatttcctctagtgttctcctttttattgtcatcagctctcaacaactctgccacttttgtgtcccaaggtaataagatgtaggaaacaaaacattgtaaagtggagcaagaaaagttatcaattaaccacatcagagtcaaatgtcttgggtgacactaaggaggatatgggcaggtgataccagagtgctttatcttgtgatgttgatacagtagcagcctctcagacattcagccaggttggatttctcatgagtttgtcacctagttttgaatcctatcccgttggtttctgcaggaaaaaaaaaaaaatttatgtggtttttaaaatttgttctgagtggggagaatcttagggggaatgtactgaatagtatcatgggctcagctcccccatgcagggccaacaaataccaaaatgagtaaactgggaagcttttctctctttctgtcttcatcccagatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtga

SEQ ID NO: 377291 - DNA, 7595 bp, Homo sapiens
cagacatcacaaaaaacattacgcagtacaggcccgctgctgatcggccgaggagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggactgggctctcatctcagtgccagtggcactgaatgttacatcacgtcagatatgttctatgtggaagtgcagttagatcctgcaggacagctttgtgatgtaaaagtggctcaccatggggagaatcctgtgagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacatcaaccaacacctttccggggggtcccattgccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttctcaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaactcctccatcctctaaagccaagtcccctatcagttcaggttctggtggttctcatatgtctggaactagttcaagctctggcatgaagtcatcttcagggttaggatcctcaggctcgttgtcccagaaaactcccccatcatctaattcctgtacggcatcttcctcctccttttcctcaagtggctcttccatgtcatcctctcagaaccagcatgggagttctaaaggaaaatctcccagcagaaacaagaagccgtccttgacagctgtcatagataaactgaagcatggggttgtcaccagtggccctgggggtgaagacccactggacggccagatgggggtgagcacaaattcttccagccatcctatgtcctccaaacataacatgtcaggaggagagtttcagggcaagcgtgagaaaagtgataaagacaaatcaaaggtttccacctccgggagttcagtggattcttctaagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaaggaaaagaagaaagtaaaagacaaagatagggaccgagaccgggacaaagaccgagacaagaaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagtttataggcaaaccaccataaggggtgagtcagacaggtctgatttggttaagaatcctaaatggcatggctttgacatcaagctgggtgaattagaaaggcatatccagaccctattaaagaaaccacagggtttgattctggttaccaggaagtcttctttgttcctgtgccagaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaatagggttcagagatcataggaatattaggagttacctctctgtggaggtattgacttgtaatctcattttcctttcaaaaaaaaaaaaaaaagctaaggtggcttgttgggatgtaaacatgttttcagatgcagtaaggtttagtgtaggacagccttcctgacccagtggcatgaaaaccattacaggattaatagttctcctacttccacaatgtgccaaaagtctgcatcccagcattttgtttgcaggagaactgatgccattcctaagagctggactcactgtttctcttcatcacaaggagaaggagtccaaactttaatcactccactgtatgctccctgagataaaacagtaaaaaatccgcagccatagttcacttaaaacaatttcaagctcacttttgaagtaatgggggcctggaatgctaggtgagcatgaagataaacccttgctactatgtagcaacccaattggacctttttggagaaataggtctgagtctggattctgggggacatcaataagagcccttcacataaaaatatagaaatccaggagactgtttcgagtgcaacagaagttctcagtatttggagggtcctctcaaaaattctgcggccttactttgatattgacacctgcactgtgccattcctgattattccattcaggatctgtatcagcgggatggggcatggtccccagcacaactcttctgggttaaaaaaaaaaagccaggtgattcctttgtgtgttatgtcgtaagtggagtgacttcatcatatatggaagaagatttctatattcagctttttctgcaggttggagtcagcatagagttggaaaatcagctttggctttctttcctgtctcatttcctctagtgttctcctttttattgtcatcagctctcaacaactctgccacttttgtgtcccaaggtaataagatgtaggaaacaaaacattgtaaagtggagcaagaaaagttatcaattaaccacatcagagtcaaatgtcttgggtgacactaaggaggatatgggcaggtgataccagagtgctttatcttgtgatgttgatacagtagcagcctctcagacattcagccaggttggatttctcatgagtttgtcacctagttttgaatcctatcccgttggtttctgcaggaaaaaaaaaaaaatttatgtggtttttaaaatttgttctgagtggggagaatcttagggggaatgtactgaatagtatcatgggctcagctcccccatgcagggccaacaaataccaaaatgagtaaactgggaagcttttctctctttctgtcttcatcccagatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtga

SEQ ID NO: 377292 - DNA, 6213 bp, Homo sapiens
gcgatagatcgagccggtaccatctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacatcaaccaacacctttccggggggtcccattgccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttctcaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaactcctccatcctctaaagccaagtcccctatcagttcaggttctggtggttctcatatgtctggaactagttcaagctctggcatgaagtcatcttcagggttaggatcctcaggctcgttgtcccagaaaactcccccatcatctaattcctgtacggcatcttcctcctccttttcctcaagtggctcttccatgtcatcctctcagaaccagcatgggagttctaaaggaaaatctcccagcagaaacaagaagccgtccttgacagctgtcatagataaactgaagcatggggttgtcaccagtggccctgggggtgaagacccactggacggccagatgggggtgagcacaaattcttccagccatcctatgtcctccaaacataacatgtcaggaggagagtttcagggcaagcgtgagaaaagtgataaagacaaatcaaaggtttccacctccgggagttcagtggattcttctaagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaaggaaaagaagaaagtaaaagacaaagatagggaccgagaccgggacaaagaccgagacaagaaaaaatctcatagcatcaagccagagagttggtccaaatcacccatctcttcagaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagtttataggcaaaccaccataaggggtgagtcagacaggtctgatttggttaagaatcctaaatggcatggctttgacatcaagctgggtgaattagaaaggcatatccagaccctattaaagaaaccacagggtttgattctggttaccaggaagtcttctttgttcctgtgccagaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaatagggttcagagatcataggaatattaggagttacctctctgtggaggtattgacttgtaatctcattttcctttcaaaaaaaaaaaaaaaagctaaggtggcttgttgggatgtaaacatgttttcagatgcagtaaggtttagtgtaggacagccttcctgacccagtggcatgaaaaccattacaggattaatagttctcctacttccacaatgtgccaaaagtctgcatcccagcattttgtttgcaggagaactgatgccattcctaagagctggactcactgtttctcttcatcacaaggagaaggagtccaaactttaatcactccactgtatgctccctgagataaaacagtaaaaaatccgcagccatagttcacttaaaacaatttcaagctcacttttgaagtaatgggggcctggaatgctaggtgagcatgaagataaacccttgctactatgtagcaacccaattggacctttttggagaaataggtctgagtctggattctgggggacatcaataagagcccttcacataaaaatatagaaatccaggagactgtttcgagtgcaacagaagttctcagtatttggagggtcctctcaaaaattctgcggccttactttgatattgacacctgcactgtgccattcctgattattccattcaggatctgtatcagcgggatggggcatggtccccagcacaactcttctgggttaaaaaaaaaaagccaggtgattcctttgtgtgttatgtcgtaagtggagtgacttcatcatatatggaagaagatttctatattcagctttttctgcaggttggagtcagcatagagttggaaaatcagctttggctttctttcctgtctcatttcctctagtgttctcctttttattgtcatcagctctcaacaactctgccacttttgtgtcccaaggtaataagatgtaggaaacaaaacattgtaaagtggagcaagaaaagttatcaattaaccacatcagagtcaaatgtcttgggtgacactaaggaggatatgggcaggtgataccagagtgctttatcttgtgatgttgatacagtagcagcctctcagacattcagccaggttggatttctcatgagtttgtcacctagttttgaatcctatcccgttggtttctgcaggaaaaaaaaaaaaatttatgtggtttttaaaatttgttctgagtggggagaatcttagggggaatgtactgaatagtatcatgggctcagctcccccatgcagggccaacaaataccaaaatgagtaaactgggaagcttttctctctttctgtcttcatcccagatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtga

SEQ ID NO: 377293 - DNA, 448 bp, Homo sapiens
ttttcaatataatatataagagggcatgctactgtgacagatgcacctgatgtaggattagcaatgttgaggtccaggccagcaaagtgcagatggaaaggtcttgtcccatagatcaaaggaaagcccatgtttagaatgtaaatgaaatgagctctttcctttgagtgtaaaatatggtcttatttactggagtagatttagtttgtttcttcttgatgcttcgagttgcagtttcactgttttaatgaaactcagctgtaatattgtttgccccacctcacctcacctccataaaagtgaagcacctttggaaatgaaaacagtatctaccaaaacccctctagtggtattgattatatttggtaagcttggtaagatgttgctgtttttaacaccagtattgtacatttggtaattaaaaaactgacttgaaagaagaatgaac

SEQ ID NO: 377294 - DNA, 349 bp, Homo sapiens
tgggagtttcactcttgttgcgcaggctggggtgcagtggtgggatctcggctcacagcaaccttcacctcctgggttcaagcaattctcctgcctcagcctcctgagtagctgggattacaggcgtgcgctaccatggctggctaattttgtatttttagtagagacagggcttcaccatgttggtcaagctggtctctaactcctgacctcaagtgatccacctgccttggcctcccaaagtgctgggattacaggtgtattgggcctggcctcaacgtattttattgaagttatctaaaagtatcttatgttttatgagaaggcctatgaatgcagtttgtcgttt

SEQ ID NO: 377295 - DNA, 145 bp, Homo sapiens
gggaatccatacagataatgtaagaaactgagagtctcagcagggcatttctgaatgagcactgcctaagttgggattatgtaagttggaagcttattgtggtaattaacaagttactatgggttaaggcaacagaagagacggc

SEQ ID NO: 377296 - DNA, 454 bp, Homo sapiens
tggtgagctgagattgcgccattgcactccagcctgggcaacaagagcgaaactccgtctaaaaaaaaaagctataactagtaacagttacccaactaagtaaataaaaccaagaaaatggaataaacaggaagaacactgtgtcacagatgacacagctctatctgtgtaagagaaaggaaaggatctagtccacttcttcctttagcatcaaaagagaagacagaagacaaactcaaagaaagaacagaaatggtagccagaaagcagaatgcagaaagtagaaattggctttgtctcatcccttcggtctgtgtggtggctgtgaaagtggttgaataagaaaacaggccaggtgcagtagctcacatctgtaatcccagcacttttagaggccgagggcagaggatggctttaagccaagtcttcccttggccaattttggcaaaagcgc

SEQ ID NO: 377297 - DNA, 653 bp, Homo sapiens
gttcaatttaatattttataaattaaaatctgaatataattgacactatttcaatcttgtttgaaacagctccataatccctaagacctttcacacacactggaactctacactacaatacttttctgtggttattataagggtacaagatgtccttacccgctcttggagaaagtctacccaataaaatagagtaaataataccaagaagtgattaaaaatgagaagccacaatggtgtctaaaaatcataagaggaaaatttaaagttcacatagcttaataaatttcaaaaattataatgcttcaacaaagtaacaaactttacataagcaacctggaatttcttaaaggaaaatacagtctagtgaaaaaatgctttcagatcaacaacagaaaagttgattaatggataatcaattcttaaggtcatctttttccaggattcctagcatttttgggaaaaaggtaattatcagaatatattctgttacttgtacgtcaagttgaaaattaatctgcaagacttagtagaaagagcactggtctcaagtctcaatgacccctgcctctacctaaaccgtgtgaccttaagcgaatcatttaacctttctgggtttcaatttactcctctgaaacatgagataattgaac

SEQ ID NO: 377298 - DNA, 1063 bp, Homo sapiens
gttgcagttcccgcctgccttaaacagaacaagcaagaagagctttcatggccagattccccccaggacattggggaagctgctggcattgtctttctgggaagattttgcttcctgggacaaaatggcagtctgattaccagtgtcgggcctgcatgctgccccggacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagcagctctagattggatttctgttgcgtttcctccatgttggagggtgtcggaatagagtctgagaagcagaaggaggtctgggagtcatgcaggaatgaatacttctggtcctttggggggaggcaagagttcaccattagtccaagtctgcagcctcccattctctaggcctgcagccaaattactggacctaaacttctgggagccatgaactgggctctacattgttccaaaggaaaggggctcaaggaatcagtgcagcttagcaattgtcccttagaaagctcacagatcaaaaacctcccctgcgtatcaattctacagccaccagcagcacttcaactgacctttctgaaaactgaaaaaatgaacaccaaataagtcaaccacagatgtactaacccacatcaggcttgcttttttagaggcctgcgctgagccatcaactgaacaggctcacttctaaatcagaaagcagcctgtgctgcgtgcctaagggaacgtcacaagacagtaggtctggaaagaagcacccaggcagccaagggtgggagctgcaccccaggatcacaaacgccttggtgaatgcctgctctacctgcagtgtggcccctttggcctctacagctggaagtcttcatctgtacaaagtgaataataaaaatattataaaacaa

SEQ ID NO: 377299 - DNA, 444 bp, Homo sapiens
acagtaccatagtagttgttgcagacaaaatccagttagaggaaaatcagaatatttacatagtctcaaagtatctctcccaggataattattaactacaaagaaaaaatagtaatccgacagtggaggtactatgttaacaaagtgatcaaggttaacatcaccagtaatgagacaaggacatcatgaacccaaagaggcagtgagaaggacacagcggcatttctgtgacgtttgttattcttgccaaaaatgcataatctttttatctttctaatcatgataaaatattgtaaaactctaaactgaggaacattctacaaaataactggccaggtcaggtgcagaggctcatgtctgtaatcccagcattttggtctcgaactcctggcttcaagcgattctcccacctcagcctcccaaagtgctgggattacagggcgt

SEQ ID NO: 377300 - DNA, 661 bp, Homo sapiens
ttgtagttatatataagatattcactagcttgagacacctgccttgtgtatctggacttgtaggctaccttagagaaggtgcttttgggctgaattcaacaccctgagttctgagccatgttgtgtcttgctgaagaggtcagcaatattgtcaaaaatgtgaacctcttggaagatcaggtctagttaaatccctgctagtccagttttcttccagatttcaagcaatactgtcaaagataagagcattcaccagtcatggatactacagctattcaagctattcatttctatagatgagattaaggttgaccatgtggctgacccaccttcatcaaacacttctgcaagtgcaaatgtcctgctttgtcatttgcaccatcttctcctcacaaagcaggcaaaggggactatgttccagctcctaacctttctccatagacaactaaaaatggcaggcagtatagtagttaagccccatcaacttcaactcacatctcaaccttattaatcactaactgatcttatgtctttactgtaagcccttgtccttatatataaaatggggattatcagagtggctgcactctgcacagtgtttggcacacagtgaggactcagtacatgttagccctcattctcctccatcctcagcaacaga

SEQ ID NO: 377301 - DNA, 381 bp, Homo sapiens
aaaaaaatttttttgtgtgagacagagtctcactctgttgcccaggctggtgtgcagtggtacggtcttggctcactgcaacctgtgcctcctggattcaaatgattcttgtgcctcagcctcacgagtagctgggattacaggttcacaccctcacaactggctaactttttttttttttccttactttttactaagtaataccatgttggccaggctggtctaaaactcctggcctcaggtgagccactcgcctcagcctcccaaagtgctgggattacaggtgtgagccactacgctggccttaactttttttttttacattcatgatatatattcagtaataatatctaacttccttattatgaacagttgggggaa

SEQ ID NO: 377302 - DNA, 1172 bp, Homo sapiens
ctattcctcaagagaaggtgctcattactagaagagtacaaagtactgaggaaacagaaaattctaagacattgcttccaggggattccagtggatgcagaaggcttggtggagtggaggcagtaaagctggccctgacagatgaacagattttaaccctgggcccatgcaaaatctcagaggagggaaggcttgggacatgggtgggaaatggtatgcagtatagtttgtctgagatttagtgaccttaaggaagagtgaggtataaaggacaggtaagtgggaccagaacatgaaggctttacctccgtctttgaaagagggcctttgggccgggtgcagtggctcacatatgtaatcccagcactttgggaggctgaggcaggcagatcacgaggtcaggagatcgagaccatggtgaaaccctgtctctactaaaaatacaaaaaaattagccgggcatggtggtgggtgcctgtagtcccagttatttgggaggctgaggcaggagaatggtgtgaacctgggaggcggagcttgcagtaagccgagcttgtgccactgcactccagcctgggcgacaaagcgtgactccgtctcaaaaaaaaaaaaaagaaagagagcctttgaagaggtttaacctaggaatgttaatatcatttaaaatgatgtgttttatgtcaatatatattgatttggaaagatgtttataaggtaaaaacataacaaaacaatacgtacagtataatcccattttaaattgtaaagcgtatatatacacacacacatacacacacacagaagaggtaagacctgtaagtttatatttctcataacattggttatctctgggtgttgagagttgagggtttttttctgtttgtttatatttatatatttcctgacttttctacagttcacacttactactgttgtagttataaattattcacttgttttaaataagcacatatatgatggctgagtgagaatgatctagaactatgccagggattagataaaaacacagagtaaaagttggccatatagtaacatttttgatgtccaaattggagaggaatccctcaaatgttcaaaaatataggaatgggtcgggtgtggtggctcatgcctgtaatcccagcactttgggaggccaaggcaggaagatc

SEQ ID NO: 377303 - DNA, 354 bp, Homo sapiens
aggatgtataggagtttgccaggcagaaaagaagggagatggcatatttggcagagagatcacagtggggcggggagatgggtggatttggctgggaatggtggccatgcctgtaatcccagcactttggaaggccgaagagagaaaattgctagagctcaggagtttgagaccagcctgggcaatagagtaagactttgtctctatcaaaaatttaaaaattaactgggcttggcggtgtgcacctgtggtccagctactcaggaggctgaggtgggaggattgcttgagcccaagaggttgaggctgcagtaagccgtgactgagggcttgtgaaacagcaagaacctgtct

SEQ ID NO: 377304 - DNA, 1000 bp, Homo sapiens
ggaagtgacagtttattttcttcacttactggtaaatgaaagccaaaaagctgaattttcctaagtaaactagaaagaacatggagtgtgtgtgactaactaggatgtttgtgtttacgtttacaaagataactttcacctacagtggttgtagatacaagtaataaaaatgaacaagaccagtattctaacgtggttaccttccaagattggaaatttaaccaggcgttgaaatgctgaaaatttctgttagaaaagatgggcgaaggaattaatggtggatactgaaaccacagttggctgtatgagttgaactgtaacaggcaatacctgttgtatggccaacatgattactcagttgcagtgcacatgttggctggttggcatatgctctgtaagcgcagcttggcagtctttaagatccatagaaatactctttgacgtttgatctctaagttccatttctgggcatttgtccttaaggaatggaaaagcaggcaaactaaagctagtcattgcagcaataacccactggaaacaactgaaaatataatgagagaattgtagagtgctggataaaatgttgtgggtccactcaaaatgattcgagtgttgtagtgtggaaaatgcccaagccaggggggacacatttaaaatggtgggtacactctgattgtgattatccaaatatatagatggacaaggacaggagggttttttgaaaagtaaagacagatgagaagtgtaatataacctaagtctttaaaacgtagaaacatttaaaaatacaattgctttgaatttgagtggactcatataaaacaagaattgtctggatttgctgtcttgctgttaaggcagggttcttgaaaagagctgtgtgtccactgcctcaatcactcctcacagtcctgctgcttctctctttgctgaaaatgctttaggggtggaatgtctgttcttaaccactgtgggtggcttcataaatcacctccttact

SEQ ID NO: 377305 - DNA, 221 bp, Homo sapiens
ccccacaccgaggcccttcacctgctgtgtgtctgtttcaggcacatgcctcctttccatgtcacgtctgatttgtaaggaatttctgtccttagcattagcaatagctgagaagtttgcactgctgccttctctccttcactcttgagagggctctgccaagtcccacaggggtatcttggtgtcacctggcattttcctgggagctcagacagctgaaa

SEQ ID NO: 377306 - DNA, 811 bp, Homo sapiens
  misc_feature (6)..(6): n is a, c, g, or t
  misc_feature (133)..(133): n is a, c, g, or t
gatcgngccactgcattccagcctgggcaacagagcaagaacccgtctcaaaaaaaaaaaaaaaaaaaaaaaaaagcaccctgtgaggaaacagtactaattatttgatattctgggaaaagtgggggacaantgtcaggcttctttgtcgaaagtttatgaactgatggctcagttaatggctgcaagtatagtgtgtgtgtatatatatatatatacctagcagtatttattaaatcccactgtggtttcaagatgtctggccgcggtaagggcggaaagggtctaggtaagggtggcgccaagcgtcaccgtaaggtattgcgtgacaatatccaaggaatcaccaagcccgctatccgccgcctggctcgccgcggcggcgtcaagcgtatttctggcctcatttatgaggaaactcgcggagtgctgaaagttttcctggaaaatgtaatccgcgatgctgtcacctacacggaacacgccaaacgcaagacagtcacagccatggacgtggtgtacgcgctcaagcgccagggacgcactctttatggcttcggcggctgagcttacctctacagtacactaccgcaaaaccaacggcccttttcagggccacctatccactcaggagaaagagtagtagtcactgctaaaagtgtagtttcacgtgtttagtagctccggttttcaagttaaatggtcttattacgccttggcttcatatcttactggccggtgaggatagtgtattaaagtttattttcactcttgctgtgtcgcccatgctggagtaatcaatggcgcgatc

SEQ ID NO: 377307 - DNA, 1664 bp, Homo sapiens
atctaataggaaaggattagagttgtagactgatgtggtcctttaagtatgcttggaatagctgaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttcctaatgcaaacaa

SEQ ID NO: 377308 - DNA, 489 bp, Homo sapiens
gtcttttctgacgttttcagctgtgatagtcgctttgttctcgcgatatttccgggtacgcgggagccccggcgacccgggcttctgtgaaacatggcggtaggctgggaccataacacaagcatgactatatgaaggaagaggaaggttttcctgaagatgaggcgactgaatcggaaaaaaactttaagtttgtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcaggagtggcagaagatgcttgagctgattcagagtaggctct

SEQ ID NO: 377309 - DNA, 4254 bp, Homo sapiens
gtcttttctgacgttttcagctgtgatagtcgctttgttctcgcgatatttccgggtacgcgggagccccggcgacccgggcttctgtgaaacatggcggtaggctgggaccataacacaaggttattgtcataggataaattcctcaatgggcatttacttagaagaggagtggtgtgcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttcctaatgcaaacaa

SEQ ID NO: 377310 - DNA, 4122 bp, Homo sapiens
gtcttttctgacgttttcagctgtgatagtcgctttgttctcgcgatatttccgggtacgcgggagccccggcgacccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttcctaatgcaaacaa

SEQ ID NO: 377311 - DNA, 1208 bp, Homo sapiens
gtcttttctgacgttttcagctgtgatagtcgctttgttctcgcgatatttccgggtacgcgggagccccggcgacccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggagtcattactcgtgtaaataatagccggcgctaaggtcgctg

SEQ ID NO: 377312 - DNA, 3399 bp, Homo sapiens
gtttcaccatgttggccaggctggtctcgaactcctgacctcaggtgatccactcaccttggcctcccaaagtgctaggattacaggtgtgagccactgcactccagcctgggcaacagagtgagacgtctcaaaaaaaaaaagattgtgctgagatcgtgaattatgtggccttgtgactttgaaaagaaatccatttgttttaaaatctttcttgattatttttaaccatggaagtgaataatgcaaactgctttgttttcttccgtaatctattccattatagttatttattcttaaataacagtttaggaaataattaaaagcataaacttattgtttattacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttcctaatgcaaacaa

SEQ ID NO: 377313 - DNA, 3267 bp, Homo sapiens
caagcctgtagtcccagctacttgggagggcacagtgggaggatcacttgagcccaggaagttgaggttgtagtgagctatgatcgtacgtaccactgcactccagcctgggtgacagagcagaccctgcctcaaaaaagatagagatagagagatagagaaatagggggagagagagagagaaatagtagcttttggttactagaaaggattgcccaaaataaaaccttgtgtttagaggaaagagtataaggaataaaactaattctttggtctttttttccctccttttctccttaggttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttcctaatgcaaacaa

SEQ ID NO: 377314 - DNA, 1372 bp, Homo sapiens
gtcttttctgacgttttcagctgtgatagtcgctttgttctcgcgatatttccgggtacgcgggagccccggcgacccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatat

SEQ ID NO: 377315 - DNA, 4197 bp, Homo sapiens
gtcttttctgacgttttcagctgtgatagtcgctttgttctcgcgatatttccgggtacgcgggagccccggcgacccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttcctaatgcaaacaa

SEQ ID NO: 377316 - DNA, 3862 bp, Homo sapiens
aacctatcgaataccaactacacgagtattattactactatcttactaattaatatagatcttactgtttgccatgaagtgtcactatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttcctaatgcaaacaa

SEQ ID NO: 377317 - DNA, 4101 bp, Homo sapiens
gtcttttctgacgttttcagctgtgatagtcgctttgttctcgcgatatttccgggtacgcgggagccccggcgacccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttcctaatgcaaacaa

SEQ ID NO: 377318 - DNA, 334 bp, Homo sapiens
ttgcttgcttctgttggttgcatattggaaaggagaaatgagttttaagcatcaggtggctgctactgatagggggtgccttttccatctcagattgaagccacagctaaggtttagactggattgcaagggacatttggaagaaagagtaatctcacagagacatcagaccccttttgtattaacagtttaataaagtcttgagaaaatgcgtctagcctgcaggccaattatttattttttattatttcaaatggcatttcatccttcatgaggaaaagcagtagatgaagcaggaagctttcaggtcatacagaacttccctcttttcaaa

SEQ ID NO: 377319 - DNA, 629 bp, Homo sapiens
attgattgaatctgcattaagtgtaacagatttcatgttagctgaagaaaggactctttcttctacctagaagatttgagatttagtgtcacaggagcataaacacgatgttcctgaagctgtgaaagaaactatttttgcatttaaggaagcaaatctctactagctgccatatgaagggaagccagagaataatgtacagcatcttttctgttaagtaaaacgtcatgaagaagtatagtaaatcacataaagagctttgtatcttaaatgaagctgaagatgctatgacttatggaaaactagtgctatatataagataaaagaagatataggtaaccttggttttacacaaatatgccatgtcatcaatatgccagttattgcacagtttatccttgaagatttgccagaacctagagagaagtataaacactagtacatacagttttgcatttcatttcaagaggcttacctctaaaggccaacatgggccacaggttaaaaaacacctgacctgttcctcacccagggttccagctttctggaagttcccactgtaaaagcaggtaatacctatacagaagaatacacacatacctaactacaatgattctactttaaagatc

SEQ ID NO: 377320 - DNA, 637 bp, Homo sapiens
actgggggtgcagtatgtctttgagaagtgattttattttctttgtatatatactcagaaagggagactgccagataatacggttattttatttttaagattttgaggaacctccatactaatttcataatgactttaccaatttataatacattctcaacaacagtgtacaaggggttccttttcttcacatcctcaccaatacttatctttttacttttgataatagccattctaacaggtgtgtggtgatatttaattgtagttttgatttgcattttcctggtgattggtgatgttggacattttttcacatacctgttggccatttgcatttcttctttgaaaaaatttctattcagggtctttgataatttttcttttctttttttttttgctattgagttgtatgaatttcttatatttttggatattaacctccaatcagatatatgacttgcaaatattttttctcattacctacgcttccattgatttcatttttttctttgctatggagaaacattagattgatgaagtctcagttgtatatttttccttttgttccctgtgcttctggtgccattaaaaaaaaatactgccaagacaaatgtcatcagacatgtatggtacctga

SEQ ID NO: 377321 - DNA, 1375 bp, Homo sapiens
  misc_feature (1)..(1): n is a, c, g, or t
  misc_feature (93)..(93): n is a, c, g, or t
  misc_feature (840)..(840): n is a, c, g, or t
  misc_feature (1374)..(1374): n is a, c, g, or t
nggagcctgcggagttcgagaccatgctgctgttctgccccggctgcgggaacgggctgatcgtggaggagggacaacgctgccaccgcttcncctgcaacacgtgcccctacgtgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttagctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctctgtgtaaagtcctattctttcatcttccactttattggcagttgacattcccttactcccaatcaacactcttaaatatttgtactgtttgtaaaacttagtacatgtccctaaatatttaactgttacttgtaaacttgtgtaatttattatttattttaatcaaaattctgaatatttcatttaaatgaaagttggaatattgccttctcagtgttttaaatagcttaagaggtagaaagcanaccccaaatcacagtgatcccagaatagactacatacttacatttgaacaggctacgaaaatgttaatcaccgggatttcaatttctttctttattcctattcttactcccttattcatttttttgaacctcccctgatttgcttcctcgggttgctttaaatgtataagatactatttatttatttatttattttatttatttatttatttatttaagacagagtcttgttctgtcgcccaggctggagtgcagtggtacgaattcagctcactgcaacctctgccttccgggttcaagggattctcctgtctcagcctcccaagcagctgggactacaggcatgcaccaccacacctgggtaattttgcatttttagtagagatggggtttctccatgttggtcgggctggtctccaactcctgacctcagataatctgtctgcctcggcctcctaaagtgctgggattacaggcgtgagccactgtgtcccaccaatctttacatttaatatgactattttcttattgttng

SEQ ID NO: 377322 - DNA, 1176 bp, Homo sapiens
  misc_feature (641)..(641): n is a, c, g, or t
  misc_feature (1175)..(1175): n is a, c, g, or t
cacttcttttttctcattgccagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttagctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctctgtgtaaagtcctattctttcatcttccactttattggcagttgacattcccttactcccaatcaacactcttaaatatttgtactgtttgtaaaacttagtacatgtccctaaatatttaactgttacttgtaaacttgtgtaatttattatttattttaatcaaaattctgaatatttcatttaaatgaaagttggaatattgccttctcagtgttttaaatagcttaagaggtagaaagcanaccccaaatcacagtgatcccagaatagactacatacttacatttgaacaggctacgaaaatgttaatcaccgggatttcaatttctttctttattcctattcttactcccttattcatttttttgaacctcccctgatttgcttcctcgggttgctttaaatgtataagatactatttatttatttatttattttatttatttatttatttatttaagacagagtcttgttctgtcgcccaggctggagtgcagtggtacgaattcagctcactgcaacctctgccttccgggttcaagggattctcctgtctcagcctcccaagcagctgggactacaggcatgcaccaccacacctgggtaattttgcatttttagtagagatggggtttctccatgttggtcgggctggtctccaactcctgacctcagataatctgtctgcctcggcctcctaaagtgctgggattacaggcgtgagccactgtgtcccaccaatctttacatttaatatgactattttcttattgttng

SEQ ID NO: 377323 - DNA, 746 bp, Homo sapiens
  misc_feature (1)..(1): n is a, c, g, or t
  misc_feature (93)..(93): n is a, c, g, or t
nggagcctgcggagttcgagaccatgctgctgttctgccccggctgcgggaacgggctgatcgtggaggagggacaacgctgccaccgcttcncctgcaacacgtgcccctacgtgcacaacatcacccgcaaggtaacaaatcggaagtacccaaaactgaaagaagtggatgatgtgcttggtggagcagctgcctgggagaatgttgactctactgcaggtaagagggaaaactgtttctgttgctaaactgtggataattatgaggctgttgatgccactgcttggcagagtctatgatgtcatataaatgatgtaggtttctaaaaatagaaaatggttcttgaataatttatttgtatttgttactgtttaataatctgtcagacaagcaatatttgtgccagccttggagtcatacaggcccgggtcagattctcagggcaaccttgtattgttgtaggaccttccttgggtctcttgacttctctggggctaatccatattcgtagactgcgagagcataaagtgaattataccgtgcttggtatataagaggcactcaacaggtgatagctttgataatggcaatgatgagtagattaataaaaataagagtctaaggaaaaaagtatgttctttctgtttgatatggtttggctgtgtctccaccctaatctcatcttgaattatagtttccgtaatccccaggtgtcctgggaggggcccagtgggaggtaattg

SEQ ID NO: 377324 - DNA, 360 bp, Homo sapiens
ggtccccacggaggatcagtgactttcccagaccccgcgggcgagcccgcgcttgggacccggcagctctgcgcgggctggttttggagggggtggtgttcgtttgtttaaattccagttgttatttggcagcatatcgccttccgagtcagtaagaattgcccacgacgtaaagagcgacttgcaggaaggggccgaagccgtcgttagcgcccgggcggcggcggccactcgaaccccgtttccgccaagcgcgctgcaacctgcggggcgagttcgttttgttttgccaaaatcatttggggacttctttgtcattcatgcccttccttttaaatgatttttatttttttccactgt

SEQ ID NO: 377325 - DNA, 777 bp, Homo sapiens
atttagtgaatatttattggtggtctgttatgtcctagacactgttttaggcactggcgatttagcattaaaccaggtaatcctgctgccatgggagctaaaaatagcccacacttgtacccactggttgtcttttgccattttgtatttcagtttttgttggtttgtttgttttaaatgtaagggcatgctgcttagaataattttcaagctgtgtgaaaatcaacgtcatttcaacttttctgccccttctggtttacactaagagctactataaacttccaggtgatagtattagctctttcatcatccattatttatcacattttttcccttcaaacttattactatcctgagaaaaacgcagtgcacaaagaaacagtaattaagaggactgaagaccctaccctaagtggagtttcatgtctttgtaatttttcgatgctttcacacataatccaggagaaaactaacgtcactctgcattcttccttcacaggtaccatgttttaaggaactgtcagttgctcagagataataagcagcctgaatttctttttatttctttgcatattgtgcaggagttcatgatcaagtgttgcccacaccaaatgcttcatccagagtcatagtacatgtggatctggattgcttttatgcacaagtagaaatgatctcaaatccagagctaaaagacaaacctttagggtccaccagaattattgggggtactgcacctatgaaggttggaaacttggggttaagaccctttgcagg

SEQ ID NO: 377326 - DNA, 2321 bp, Homo sapiens
gcttaataaatcccaatccagcctagctgatttactgaagaacaaagggatgactagtttttgctacgccaaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagaacaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaaaaaaaaaaa

SEQ ID NO: 377327 - DNA, 1668 bp, Homo sapiens
aacagttaatataaaagtgaactaaatggctcaaactaaggacaagaggtaagttagtgaagaatgtattgaatatttatttgactgtacactgataataattagatatagttatttgagtttgtgctaatccttatttatgcttctttgatagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagaacaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaaaaaaaaaaa

SEQ ID NO: 377328 - DNA, 2514 bp, Homo sapiens
aagtagcgctgcggttggcagcggcgggatggagaagctgggggtggagccggaggaggaaggcggcggcgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagaacaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaaaaaaaaaaa

SEQ ID NO: 377329 - DNA, 743 bp, Homo sapiens
aagtagcgctgcggttggcagcggcgggatggagaagctgggggtggagccggaggaggaaggcggcggcgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgattatgtggaagaggttcgaaatgatgacggacaaggtaattcggttccattgtaaattatgccgagtggcagttgatgatc

SEQ ID NO: 377330 - DNA, 638 bp, Homo sapiens
tttaaaaaaattttatttacagcaccattgaacatctttgaaaggtatgctcatgtacatacattactgggggattcacatgcaattattaatgagttatttaaactttatgtcttagagttttgacagttctctcaaatgtgaggattgcaactctagcaaaattgcctgtgaggacaggaggagaattttaagcaacaaaactccacaatactgtaacataacctcagatctccaggaagaggtcactctcccttgaaaatcatcctttccggattgttctcattagagtgcagagtaggtgcagtgtctggcatggctttgtactaagaggtgacagttgatcatctagcaaacattcaagaaagttccatgtaaacaaaaaggtacgaaataaaacacatgaaaagagaagcaccagaaaatgactcgtctgcattatctaaactccagatgggtaagaacatgcagattacattgaggattatctttcaatgcaatttccacttgagaaactaaattcctggtttgacaacctcatttctacctgtggctactcaagggtaaataaactaagaagcacaaatacgtgacactttatcaggtgcatgacttctatagagcaggcatgcagtttc

SEQ ID NO: 377331 - DNA, 183 bp, Homo sapiens
ttcctgaagccaagtacataggaagcatttattccgacagaattaccataaaaattaccaaataaccaacactgcatatactgattctatttctgaaataataaatttgcctaaattttaccaattccagaaaaaagaaaccaaggtaacatatttctaaggagaaatgccttctataaccac

SEQ ID NO: 377332 - DNA, 3299 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377333 - DNA, 3404 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcaggtaaactacccaggtccctctgagcagccctggtaacaagggtgggaagaagggacagctgttctccggcccctcctccagccccgccctctcctcattgcccagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377334 - DNA, 3182 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377335 - DNA, 3418 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgagacggagtcttgctctgtcacctaggctggagtgcagtggcgcgatctcggctcactgcaacctccgtctcccgggttcaagcaattctgtctccatctcccatgttcctgggattacaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377336 - DNA, 3181 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377337 - DNA, 3477 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttgagtcccgtttgttagatctctattccttgcagattgtgttctgaccccacccccccacctcgtggtatcgatcatgaaggccacgtgagtcaagacacgagtgtgcagggccgtaaagaaatgtcgcctgtcatcagctcaagttccctgtcttagccacatgctgtcattctttacgg

SEQ ID NO: 377338 - DNA, 3320 bp, Homo sapiens
  misc_feature (3305)..(3305): n is a, c, g, or t
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttgaaaaaanaaaagaaaaaaaaag

SEQ ID NO: 377339 - DNA, 716 bp, Homo sapiens
ttacatgactcgttcaggcagacagagttcactgtcttgtattccacagtgtgacagtggtggccccactccctggcaactgagggccgtggcgggtcggggggaggccatcttaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377340 - DNA, 989 bp, Homo sapiens
tgggcaacaaggtcttgctatgttgcccaggatggtctcaaattcttgccctcaagcaatcctccctccttggcctcccaaactgccgggattacagacaggagctaccatgcctagtttcttctcactttcctctgacaaacttttcaacactcacctgttcccccagtcgtcctcatggatttccattagcccctctgttgacatctgtagccaagggaggccaagcagcagcacttcattcaggtagattcaggatatacacaccagtacctcccattcctcctcttattccattagcctttgtgggggcaggggctcacctggttaatgcagtgccccaggttttgaagggcccatcactttgtttgctttgaggtggtcatatcgggtgagtcatgtgctaagttctcttcccagctgtctgtgagatgtgtggtatcgtgggtacaagggaagccttcttctccaagaccaagaggttctgcagcgtctcctgctccaggagctactcctccaactccaagaaagccagtatcttggctaggttacaggtgagaggcaatcacttggatccttcccggtgcctttggtgctgagacaggaaccaccaagtgactgaaggccagggccaggaaagtttgaaaaggtccttgcttgtggccagctggtatttattatgttctcaaacttcacaggacagtagaatccatttgtggagctttttaaattataggttcctgaagctacgctccattacctaccgtcatcccccagagtctggtgtattcagtacattttaaacaagaactatgggggagtctgacacccttggtcttcaccccacacttttataaatcctttcaaaggaagttgggaaacaggcccaaggttcaccagccacggtggcttcaagaagaccatgcctcgtcggactccatgtcacaggcagctacctagaaagtcttgccagttttctaaattactga

SEQ ID NO: 377341 - DNA, 3180 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcaggtgtgggctctcgtggccctaagaggctctgactttctttcctcttcttttttccttcttcccccgcccctgtgcccatctccgttctttggcatgaggtggagatgtctcatggaccactttaagtagagagtgagccccgtcacccagcccctgctcctgacttctctgtctccctttccctctggcctgcagagctccttccttcatcttgcccactctgtcatatgttcgtgcccttgtgcacccaggtaaactacccaggtccctctgagcagccctggtaacaagggtgggaagaagggacagctgttctccggcccctcctccagccccgccctctcctcattgcccaggtttggcttcctgtcttggggtgtctcgtgtgggagggtggatggggtctcgggatgcgcctgtgccctgtgtcctcccagggaccctcttctcatctctttcacccttgtctttcaacaacagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaag

SEQ ID NO: 377342 - DNA, 3584 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagagctccttccttcatcttgcccactctgtcatatgttcgtgcccttgtgcacccaggtaaactacccaggtccctctgagcagccctggtaacaagggtgggaagaagggacagctgttctccggcccctcctccagccccgccctctcctcattgcccaggtttggcttcctgtcttggggtgtctcgtgtgggagggtggatggggtctcgggatgcgcctgtgccctgtgtcctcccagggaccctcttctcatctctttcacccttgtctttcaacaacagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377343 - DNA, 3427 bp, Homo sapiens
ggcatgagccaccgcacctggcccacattgttatacagtattctatttgaaccatgttaaaatatcatgcatttgtaaatccacagaggagcctggtgaattcctaacacatattttctgtcttgttaagctgttgaattgcatcatggtggagaaatgtgtaaatagaagtaatgatcttggtgtttgtaaaaggggtatttgaaaggttcccgaaagtgtgagggggctgatagcagatctgcagcttctccccccgtgcactaaagccaatcataattctttctacctggtttgtgtcatcctccattaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377344 - DNA, 3296 bp, Homo sapiens
tgggcaacaaggtcttgctatgttgcccaggatggtctcaaattcttgccctcaagcaatcctccctccttggcctcccaaactgccgggattacagacaggagctaccatgcctagtttcttctcactttcctctgacaaacttttcaacactcacctgttcccccagtcgtcctcatggatttccattagcccctctgttgacatctgtagccaagggaggccaagcagcagcacttcattcaggtagattcaggatatacacaccagtacctcccattcctcctcttattccattagcctttgtgggggcaggggctcacctggttaatgcagtgccccaggttttgaagggcccatcactttgtttgctttgaggtggtcatatcgggtgagtcatgtgctaagttctcttcccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 377345 - DNA, 2443 bp, Homo sapiens
agcggaatggcgggagcaggcacggaaccggcttttcctccttcctgcagcgtgatggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccgggggctgcccgtcttgcgggggctgcccgtcttgcgggggctg

SEQ ID NO: 377346 - DNA, 127 bp, Homo sapiens
cccactaagacgcgacccctcagacaggggtccaagaagcccctgctggaggacgaccctcagggtgccaggaagatctcgtcggagcctgttcctggcgagagtaagagccaccgggctgggtcaa

SEQ ID NO: 377347 - DNA, 462 bp, Homo sapiens
gtctcttctgttccagggtcagaagcccctgtggtccccaggcaatcccagggaacccagatacctctttatttctctttgttcacagcttagtttatttttaataagatagctgttttaggatcctatgtggaggatgttgaatcagtttctggcttaggcatcaactttttctcacttcaattctatttgcctttttgtcaaatgacaataaactttcttctctcatgagttgagtcacattgtttagtggtgattttatataaaaatatgtttcaccagatgggtgatgatttcctaagcattttgttctagcacagtgacataacagtgctatatcatatgtcattgatatctttgaccatcacttgtgacaattcgttttcttaatttgggggaggatttttaaaatctcagtagaattattgtcctcaccactacttagactacttaaacaagtaa

SEQ ID NO: 377348 - DNA, 1951 bp, Homo sapiens
ggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggcggaagcccggctcgctgcaaaacgggcggcccgcgcggaggctcgcgagatccgcatgaaggagctggagcggcagcagaaggagatctatcaggtccaaaagaaatattatgggctggatacaaaatggggtgacatcgagcagtggatggaagacagtgagcgctactctcgtagatccagaagaaacacatcggcttctgatgaagacgagcgcatgtcagtgggtagtcgtggaagcctgaggtcgcagcctgacttggagtatgggggtccttacgcctggacaaatggttatgatggagaattgtatggatcacagtccctgaatagaagatctggcaggccctcctgtctgtacagcgctgcccggccttcggggagttaccgggcgtctgtgttggatgaaggcagcttcggtgggacccgacggggcagcacctccggctcccgtgctccctcggagtacagcggccacctcaactccagctcccgcgcctcctccagggccagctcggcccgggccagccctgtggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctg

SEQ ID NO: 377349 - DNA, 588 bp, Homo sapiens
taggaccacttcatttatctgagatgatggataccaagaatcagtgtataaaaatagtctaaatggctacaacagccgtcctgggaggtgcttaagcaatcccttttctttactgacccctcattcaagtggagactttgcgtaactctaacgcagctgtgaacacgcagacaaagctagaaagtgatgcaaatatagtaacctctggggccccgtgctgtgtccgtgtgcttcaagatgcgcatgtctttcatggagtatgaacagtaacatttcttggattatatatactaagcgaaaagcttaatacttggattttgttagtatctttaggcagagtctctttaatgtctagagtccactagtgttttagatggtagaagcctccttctggttcctgcttctgaagtaacttgctcatctgtgcaaatcttcttctttctcttggctctgctgcacactcaggcattagagaggcagaaagagttctttgattccgtaaggagtgaacgggatgatcttagagaagaagtagtcatgctgaaagaggaattaaaggtatgaagccaaactacagttttatttaaa

SEQ ID NO: 377350 - DNA, 743 bp, Homo sapiens
acccaacaggcgccgcggctgctccggtggcgccactgactcggaggcggctgcggagagcggggcgctggcccgtggaggcggcagcggcggcggctttctagcggatccgagattatatatctttgaatgatgcaggccactgcagtggtggagacagcatctggtaaaggctaccacagtaatggaggcaacctccaaaaagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaataggaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgca

SEQ ID NO: 377351 - DNA, 4331 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377352 - DNA, 4267 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377353 - DNA, 4278 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377354 - DNA, 4142 bp, Homo sapiens
ggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377355 - DNA, 4517 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377356 - DNA, 4055 bp, Homo sapiens
ggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377357 - DNA, 4559 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggaagacagtgagcgctactctcgtagatccagaagaaacacatcggcttctgatgaagacgagcgcatgtcagtgggtagtcgtggaagcctgaggacaaatggttatgatggagaattgtatggatcacagtccctgaatagaagatctggcagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377358 - DNA, 4381 bp, Homo sapiens
caagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgctgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377359 - DNA, 2998 bp, Homo sapiens
  misc_feature (2825)..(2825): n is a, c, g, or t
  misc_feature (2866)..(2866): n is a, c, g, or t
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattctacttacattggcagtggagacgaaaagacccncttcacactgtagacttcctgctgcaccgcggcctgccgcnctgcctctagcttaggacatggtacacgtcttctttgcgttttgccacttctcattcccatcctctgagtatctatctctcgctttcacgcaatctgccggcggatcctcctagaagtcgacctcgcgaggc

SEQ ID NO: 377360 - DNA, 2770 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattagaacgtacactgataacaaatatgtctttctaatctgggtgataacctcaatgattacatggaaatctacaagtaacagtctatactaagcagtagagcacctggtaatgtcatacagagcggagc

SEQ ID NO: 377361 - DNA, 2587 bp, Homo sapiens
  misc_feature (2546)..(2546): n is a, c, g, or t
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccatagcagtccagaggaggattggagggaaagcaagaaactgtccatgtctaactaagacgcggancccgggacggtgtgaattacaggcctctggttaacggctgg

SEQ ID NO: 377362 - DNA, 4018 bp, Homo sapiens
taggaccacttcatttatctgagatgatggataccaagaatcagtgtataaaaatagtctaaatggctacaacagccgtcctgggaggtgcttaagcaatcccttttctttactgacccctcattcaagtggagactttgcgtaactctaacgcagctgtgaacacgcagacaaagctagaaagtgatgcaaatatagtaacctctggggccccgtgctgtgtccgtgtgcttcaagatgcgcatgtctttcatggagtatgaacagtaacatttcttggattatatatactaagcgaaaagcttaatacttggattttgttagtatctttaggcagagtctctttaatgtctagagtccactagtgttttagatggtagaagcctccttctggttcctgcttctgaagtaacttgctcatctgtgcaaatcttcttctttctcttggctctgctgcacactcaggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377363 - DNA, 3755 bp, Homo sapiens
cacaggccactacctgtagttaaaaaggatgcctggtggaagtagcttgtcaccagcaaatgaaagcatggattggaacatctgagaaagaagtagcctttggaggacgatatcccagatttgtgtgtgttgaccgaatatttacgagtgctgcaccctagcatttctcttgtctctgtggagttaccctgtacttcaggaaaaaatggttttcttttttattattgtattaaaacagagtttaacctaatatcactgagtaaatattacgatgagcctatttttgttcccagaaaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377364 - DNA, 2181 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagattatatatctttgaatgatgcaggccactgcagtggtggagacagcatctggtaaaggctaccacagtaatggaggcaacctccaaaaagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaataggaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgca

SEQ ID NO: 377365 - DNA, 1140 bp, Homo sapiens
caagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgctgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagtaagcattagtatgatacagaatgttaacaataggctgcgtgcagtggcccatgcctgtaattctggtactttgggaggccaaggtgggaggattacttgagcccaagagttcgagaccagcctgggcaacatggcgagacatcatttctaaaaagaattaaaacaattagccaggtggtacatggctgtagtcccagctacttgggaagctgaggtgggaggatcacctgagcctggaaggttgagactgcagtgagctgtgatgacaccactgcactccagcttgggcaacagagaagacactgtctca

SEQ ID NO: 377366 - DNA, 1171 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggagatctatcaggtccaaaagaaatattatgggctggatacaaaatggggtgacatcgagcagtggatggaagacagtgagcgctactctcgtagatccagaagaaacacatcggcttctgatgaagacgagcgcatgtcagtgggtagtcgtggaagcctgaggccctcctgtctgtacagcgctgcccggccttcggggagttaccgggcgtctgtgttggatgaaggcagcttcggtgggacccgacggggcagcacctccggctcccgtgctcacgccaaccatactaacaggtggtgaaaccgtcttcggttaataaaaacgggaaaaggacaacttgacagaccacacatcattctcgtccctggatagttgaggaagaggaacaaattttaaaacttggaatgttacgcatatttcattccctgtttgtattttgttgtctctctacctctttcttcaatttgaaatgataggctcagctatgagggtaaagatgtaataggtgcaccataaacatttgtgaatgaatgcgtgagaaaagcaacaaggtagaaaaatgagatggaacccgtggaagtggggagacgaatttgcgtgtcccagggacctgtggaaacggagcgttcagtgctaaccggtgctccctggcggtggatctcctgtattcagaggctcctccccaatcctataaaaatgtcttcaagccctccaggaaatagaaag

SEQ ID NO: 377367 - DNA, 1419 bp, Homo sapiens
cacaggccactacctgtagttaaaaaggatgcctggtggaagtagcttgtcaccagcaaatgaaagcatggattggaacatctgagaaagaagtagcctttggaggacgatatcccagatttgtgtgtgttgaccgaatatttacgagtgctgcaccctagcatttctcttgtctctgtggagttaccctgtacttcaggaaaaaatggttttcttttttattattgtattaaaacagagtttaacctaatatcactgagtaaatattacgatgagcctatttttgttcccagaaaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagattatatatctttgaatgatgcaggccactgcagtggtggagacagcatctggtaaaggctaccacagtaatggaggcaacctccaaaaagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaataggaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgca

SEQ ID NO: 377368 - DNA, 811 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggtaagaggaaagcgcttccgaaactttctttcgtgactgcggcggggtttcaggggcttccagctcgttccgaggtcaatggcaggcgcaggtgcccgggaggcgtggggtgggctctggcgggaccccagcgcggtgggagcgggcgcagtgggcgcgggtccgtgagtggcccggcgagcggcgtccctcatgcgctaggaagcacgctttattgtgggacgccacctccaaggacgaaaaggcacatggtctctccccgcccgaggtgatgggctgcagacaggctctgaccaggtctgcgcctggcctggagtcacagggagctgctagtttgctattttacaaaatacagcatcaaggaccgggtggccagagccggtgccctcacccgctgttggaaccaccggggagcggctggggtgctttggagcactcaacccgctcagcacc

SEQ ID NO: 377369 - DNA, 344 bp, Homo sapiens
acctcccaccccagaaaaaaacatttttacccactggtttaattaaagcctttaaatgaaggcaaagaaaatatttatgtgacatttagatcagaactgctgtattatggtgcagtgggactacctaagcttttttaaagcacttttcctgtgtccatctgtctctaaccttttcatgctgtttcttcattgttaggaagacagtgagcgctactctcgtagatccagaagaaacacatcggttagtaccgtgttcattcattacttgggcaatttgattgaattctaatttatgcttgcagtggctgaagtatatataatatattcaatctcttaatgatgat

SEQ ID NO: 377370 - DNA, 366 bp, Homo sapiens
taaccctttatctgctttctgtctgttcctttcctcaggaaatccgacagctacagcagaaacaggcgagttctatcagggagatttctgatcttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcg

SEQ ID NO: 377371 - DNA, 311 bp, Homo sapiens
aagacatgcgcatccttgaagcacacggacacagcacggggccccagaggttactatatttgcatcactttctagctttgtctgcgtgttcacagctgcgttagagcctccttctggttcctgcttctgaagtaacttgctcatctgtgcaaatcttcttctttctcttggctctgctgcacactcaggcattagagaggcagaaagagttctttgattccgtaaggagtgaacgggatgatcttagagaagaagtagtcatgctgaaagaggaattaaaggtatgaagccaaactacagttttatttaaa

SEQ ID NO: 377372 - DNA, 4427 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377373 - DNA, 4280 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377374 - DNA, 4442 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggagatctatcaggtccaaaagaaatattatgggctggatacaaaatggggtgacatcgagcagtggatggaagacagtgagcgctactctcgtagatccagaagaaacacatcggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377375 - DNA, 4442 bp, Homo sapiens
ggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggcggaagcccggctcgctgcaaaacgggcggcccgcgcggaggctcgcgagatccgcatgaaggagctggagcggcagcagaaggagatctatcaggtccaaaagaaatattatgggctggatacaaaatggggtgacatcgagcagtggatggaagacagtgagcgctactctcgtagatccagaagaaacacatcggcttctgatgaagacgagcgcatgtcagtgggtagtcgtggaagcctgaggacaaatggttatgatggagaattgtatggatcacagtccctgaatagaagatctggcaggccctcggagtacagcggccacctcaactccagctcccgcgcctcctccagggccagctcggcccgggccagccctgtggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377376 - DNA, 4403 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377377 - DNA, 4327 bp, Homo sapiens
caagggtgtgaggcacgtgagggcatcgccatgcgtattttacaggcctctttctctggactgtccttcaaagggaatgacctttgtctttccaggacctacccagtgagatctgcctgccattttcctatgagtcagttggcagtcactggcttgtggccctatgtaattatctcagccatcacacactggctctttcacaagggctggtcacacgcctcgagtgattcttcagaaatctgttgaacagcctgacacccagccctaggacgctgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377378 - DNA, 4323 bp, Homo sapiens
caagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgctgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377379 - DNA, 4589 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377380 - DNA, 3561 bp, Homo sapiens
ctttgcttcagggcctccttgacttcagcaaactgaaattgcagtatactgtgggcgtgtttttccctttcaaattctttgtttttctcttcgtactgccgaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgaaaaaaaaag

SEQ ID NO: 377381 - DNA, 1995 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagattatatatctttgaatgatgcaggccactgcagtggtggagacagcatctggtaaaggctaccacagtaatggaggcaacctccaaaaagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaataggaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgca

SEQ ID NO: 377382 - DNA, 1806 bp, Homo sapiens
ggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagattatatatctttgaatgatgcaggccactgcagtggtggagacagcatctggtaaaggctaccacagtaatggaggcaacctccaaaaagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaataggaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgca

SEQ ID NO: 377383 - DNA, 835 bp, Homo sapiens
ccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggaagacagtgagcgctactctcgtagatccagaagaaacacatcggcttctgatgaagacgagcgcatgtcagtgggtagtcgtggaagcctgaggacaaatggttatgatggagaattgtatggatcacagtccctgaatagaagatctggcaggcacatgatggaatgaaagataatgtttttcaactagcaaacattctgagaatgttagccctccaacattctgattgttagtataaggggtagatattgataagaatctcaagttttaaaagatctgaaattaaagattaactctttcattactgtattcccctgggtgtatgtatataatgtgtgtattaagtatattcagctttcaaagatactaaatccaacattttcgcag

SEQ ID NO: 377384 - DNA, 450 bp, Homo sapiens
gggaaagtgcacaattctatcaagttccttagggacgataagtatgatgaaggccagaaatagggaaaggaagagaggattggtagaataaggtccaaatagctgatgggcttgaagaagagcctttgatagaaggagggccatttttccctaatatgaaatgaaaggagataaatatgagagcaatctacctgtacctctttcccttcataaccaagggctattcaacattcatcagagcacctctgatgaaggtgcatagctgggaatggaattcagcacatattgatggtcaggtcctgtgctagatactttatgtaaatcatctcactgcagccctttgaggctgacagcataatcctccctttcaagatgaggaaatcaaggctcagcatggccaagtcaactgcttgtctctttcctctccactgattgccaggtcacattccc

SEQ ID NO: 377385 - DNA, 647 bp, Homo sapiens
tctgaaaacaagcaaacaaaaaacaaaaacaaaaacaaacaaaaaacattgacagctaccttttgagtaaaaagccatcagtacacaataaaatctttctgtgggaaaaaggcaaagaaataaaggttgctactgtgtgaataatttggcatgtctatctagctatatgagcattgtgcttaaaatattaaggaaattaagtatgggctatacaatgtaggcataatgtgtatctgaaaaaatcctgtgtagatggaaagtgtgctgactcagctggttcagtttctgggcctcgtgtgggcccccagcagcttaaccacttctctcaagtccttggtttcctcatgggagaaatgagtatgttgaattagatgacctttcaggcatctcatcatgctgagttttttttccgcagcagggaacatgctactttacattctgtttagggtttgctcagtgaagggggagtaccaggaatctggggaattcccagaatacctgggcactatatatatatatatatttgcaacacatttaatcataaaagattaatatccttaatctctaaaaggattttaaaagtcattaagaaacaatgaccgtcttgctggaaaagtaggtaaaactgatgacttacaaaagaaaaa

SEQ ID NO: 377386 - DNA, 610 bp, Homo sapiens
cgagctcggtacccctccagctggcccaaaggacagggttcgggaagcttctgagagctgaacgtgtggaggctgacagaaggtgaagaactcatccatgtgcctggagggtgatgtaaccccaactctatggagatagaagctcctgctctgggcccttccagaccgccctgtctgtatctcttcatatggctgtttatttctatcctttaaaatatcctttgaggttgggcacggtggctgatgcctgtaatcccagcactttgggaggccaagacaaggggattgctggagctcaggagttcaagaccagccagggcaacagaatgagaccccgtctttgcaaaaactacaaaaaaattagctgggtgtggtggtgtatgcttagagtcccagccacttgcggggtggggcgctgaggcgtggggtttgggggggatggaggctgtagtgagccgagatcatgccactgcactccagcctgggtgacggagccagatcctgccactgcagtcattctggatgacagagtgagaccctgtctcaaaaaagaaagaaaaaaatttttttcctctgtaataaagcaataaacataataagggtttccctg

SEQ ID NO: 377387 - DNA, 356 bp, Homo sapiens
aataaaatggtttaactacacgtaaaaatgtgttcagtgttagagttcaaccagcactgcagaaattacatgtttctgtcagtttaggtttttgatttcttatttccctgttaccaagcatcagcaattattcttgggattattagccctggaattgaaagatatttaatggtactcctgttgcattaatttgtctgagtttatgtagaaaagtattaaaaatgttactgttggagtctgataaaaagttctggtcttttaaaaatatgtgtatgagaaatagcatgaactcaggaggcagagcttgcagtgagctgagatcgtgccactgcactccagcctgggcgacagtgaga

SEQ ID NO: 377388 - DNA, 439 bp, Homo sapiens
ggtcgacgctgaggacagagagaggacccaagcaggcaactagttggaggacttgtacacgtttccttccagcagtatgtcagagaggtggcagcccactggggacagggctgcctgggttctgtgctcgaggggaccttgagcaggctatttaacccttctgtgcctcagttgcctgatctataacatgaaaattagcaatccctactagataaagttggggaatttacagagttaatatttgtaaaggtctgagaatattcctggcagagtaagcactctgtgagtatgacactggcatttcttctgcagcactacatgctgtctatgcctttgtccaagtctgaaaccctagaactcttagaattcagttcaatgtttacacaatcctacagttctgctaggcttctatgatgctactattctgcatttgaatgag

SEQ ID NO: 377389 - DNA, 283 bp, Homo sapiens
ctcaagggaccccagacagccaaactactcttgaaaaagaccaaagttggaagttttatacttcctaatttcagaacatgttacatagctacagtaattaaaacattgtggtataaagtaaaaattgcgtataaggacagatacacaaaccaatagaatagatagcccaaaaataaattttggtatatatggtcaaataatcttcaacagggtaccaaggtcactcacaaggactgtttaacaaatgggaagactgggtatctacatgcaaaaaaataaaaat

SEQ ID NO: 377390 - DNA, 2772 bp, Homo sapiens
  misc_feature (985)..(985): n is a, c, g, or t
  misc_feature (2145)..(2145): n is a, c, g, or t
gttttactatgttgttggctattttatcgttgagttgtaagagttctttgtatattctagatacaaatcccttatcaggtatatgacttgcaaatatcttctcccattctgtgtgttcctttttgactttcttgattgtatgccttgaattaaaaaaaatgcctaattttgatgaattccaagtttatcattttttttaattttttcacctgtgcttttggtgtcatctaaggaggttttgcctatgcggtcatgaatatttactcatctgttttcttctaagagtgataatagtttcagctcttatattgagatatatgatatattttgagttagtttgtgtgtgtgtggtgtgaggtaggggttcagcttcattcttttgcatgtggatatccagttgtctcagtatcaattgttgaaaagacatttcccccttggatagtcttggtgctcttgtcaaaaaccaaataactgtaaatggagcaattgtagtttgaatggaatgggtcagcacttggtggcagcaggggtcttggctatgtagtttcataagctcccactcctggagagcctctgttttcctctcaaagccaggtttttctgtctcgctgcgttttggtgcctgaaaggcttgggtgggcatggtacctggagtactgttgttcggagcacaaagtgaggagaaaagaccactctactttgtgggaggtccttggggcagtttgggcagcagtgcctcccccaggagtcagggtccccaccccagaggaatgtccacagagcagagccattggcctgagctggactgaaaaagaaagagccaggtggggagaggatttgatttctcccttggtctaaagcaggcagctgacattgggtgagggaatggggcaggcctccatgtgctatcgggaatccccaggaggtccctacagaaaacttccacccccagcccagcttgtttatcacagcccttcagtggtancttcctcctgtggcttgatccaaacgggggctgcatatgtggccaaaatgcacataaccctgtgaggcacagcatagcagcttatcttccctgaaagtggaaggacaaaagcaggacaaagatgaccaagccagggtgggagagaggggaggagacactggaaggggaggtgaaggggcagactagggaggccaggaccaaggcagactctcatgcaccaggcatattctgcccagccaagggctctggcattcagatgagggagagggagaggaaagaggagagaatccagtgagaccaatccatgaagtgtcgggaggaccctggaagcaaaggctctggactcaggtggcatcaatgggactaccagtttccagtgaatatgtgggagtggcctaggtccagctcaatcagaagcccatttgttcaaggccctggtattactgaaggcccagccctgtctcacctgccagaaagcacgtggcctctccctggctaggctaagggctggttgacggcatcataaaaggaatctgcctgggagccctcaatttgtttcagtttcctcccccaaggccaagaagggattgggttgcctctgttgttgttgctgctgctgctgctgctgctgctgctgggggttggaaaagaggaatttgtgtgaccagatccccttattgtatagaagaagagaaatgtgagcattcagagatggtgagatgtcagacacccagccacacagccagtgagagacatgttggggacagggccaggcctgccagttcatggcccaggggtctttctcatgagatcaactgaccagtgtgtcttagcacctgccatgcaaatagaaggccctactgctgtcatctccacgtattccagaattactcagctgttctatgcaagccaagtcaacaccaatgtcataaaggagagactaaagtaattctctacacagcacatacacggcatatatggcctgtatgcttcctggacagccaacaggggtgccgagggagtgagtccctcagccttgcctggagccttgctgatacttcagtttgcctcacaaacacggttaccttccatgacatgaaggaggcacacgcgggttgacccctgaccctgtctgcttgttagaatcacgtcgggaaccngggacaggcttagaagcccaggtcccacctcccacctgctgaatccaaatctccagagcgtggcctgggaaatcaaatttgtcagcttccttcccaggggactttgatacatccaccccagtggaaaccagcagcctcctttagtcaagcgaatgtttccctgactgtcaccttctccccctgtataagatgcagattgttagcggtaaatggtacctggattccaacctcagttctccactgcagttggggagatctggccagggcaagccacactgctccttcaggcacagccttgttcatcccgcactcacctgtgttctcttcctctctgtaggacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaa

SEQ ID NO: 377391 - DNA, 1024 bp, Homo sapiens
tacctgaatattacaaaaaggaccataccagaaagtactgacaggggaagttatcctaattcagaaggccatgggaggccacctgaagaagtgatatttagccgaaggtctagaatgatttggaggcaatcagggaaaatagagaagtttgcactctttgtgttcgagtctcaaatgccatccagggcgcctgtgtcttttcgttctggctgctgcctctacctttttctactcctggcattgccttgtggccttctgttcctgagcctcttctgtgtgtgcagggaggcagcaggttgtccagggtgataagaatggtaacgtcatagtaactactgtttattaagcgtttagtttcctgatctcattcagcagccctcagtcacagaaaatgaatgctgagttctcagagtttattgctgtctaagtgggcacgtaggccctagtcagggccctgccaggttcccagggtggggaaggctttctgtaccattacagatcacaagagttcaagaaaaaatgactttatgagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagtataaagtaattagagactaagtgacggggagaggagacatcagcaacataattttggaagctgaaaagcagatggagaagtggagcagttaggtttcagtagacccaagaaagctgaaatccaagttggcaggggaacaatcaagaagcaatccagcttgaactacaaaacccccca

SEQ ID NO: 377392 - DNA, 1853 bp, Homo sapiens
cagccgctccacgcggcgggagggcggggaaataagaggactggccgcccgtgcatccagccaagctcctggcggacggatatcggaggcccaggcattcgagggacgtgcagttgcatcacggagagcctttgggaaccgtctggggtcttggcggagacatttgtgtttcgggggcagcgccccttcctacatccaggaggccgcgttgcccgggttaccgaaggccgccgcaccgacgccccgcccctgaccgccgatgcccctcccacgccggctgcggtcgccctcggcgctgcctgagagagtttgcgggatttcaaggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaa

SEQ ID NO: 377393 - DNA, 1539 bp, Homo sapiens
tggtcggcagggtggggtttcttggcattcctcaggccgggggatgcgacgtctgggtgtggaggtgatgagctaggggttctgtggcactccggctctgctcagggcgacctgcgtaggggcctctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaaggggaaaaagttacttaaaaa

SEQ ID NO: 377394 - DNA, 1349 bp, Homo sapiens
tggtcggcagggtggggtttcttggcattcctcaggccgggggatgcgacgtctgggtgtggaggtgatgagctaggggttctgtggcactccggctctgctcagggcgacctgcgtaggggcctctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcaggcggcgccacctgactgagagaaaatggaaacacgaggttgctgattgaattctacgcatatctataggcatttcagaaagatctgtctggctcttttctgtaagaccattgcttaataaaaatgatggcttctaaatgtaatt

SEQ ID NO: 377395 - DNA, 405 bp, Homo sapiens
ttccaccgccctctactagcgggagcagtcataaaagcccacccattttcaaggcaagaggtcatagcctgcgcctctcaaagggaggattgtcaaagccgcactggaagatcatgacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaa

SEQ ID NO: 377396 - DNA, 522 bp, Homo sapiens
ggccaatttttgtatttttagtagatggggtttcaccgtgttagccaggatggtctcgatctcctcacctcatgatccacctgcctcagcctcccaaagtgctgggattacaggcatgagccaccctgcctggccaaagtgggacacatttccaataaacaattcctactggaagaggccccacgtttccctggagagggagtgtgctccaatgggaagggttggactttaggatcaggctgacctgatcctgagttcactttctgattcttactggttttgcgagcttccaccaattattcaccctcttgtggtacctcagctactgtaccagtaagatgtagggttaatagacttttgattaaagatggcagattgaacataagctttaacctcagttgcctctcaatacagtaatagtaaagggtttggttttttccctctcaggtataaagtaattagagactaagtgacggggagaggagacatcagcaacataattttggaagctgaaaagcagat

SEQ ID NO: 377397 - DNA, 1808 bp, Homo sapiens
tggtcggcagggtggggtttcttggcattcctcaggccgggggatgcgacgtctgggtgtggaggtgatgagctaggggttctgtggcactccggctctgctcagggcgacctgcgtaggggcctctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaa

SEQ ID NO: 377398 - DNA, 1840 bp, Homo sapiens
tggtcggcagggtggggtttcttggcattcctcaggccgggggatgcgacgtctgggtgtggaggtgatgagctaggggttctgtggcactccggctctgctcagggcgacctgcgtaggggcctctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaaaaataaaaaaaatgggcttgttggccttagcc

SEQ ID NO: 377399 - DNA, 1135 bp, Homo sapiens
tacctgaatattacaaaaaggaccataccagaaagtactgacaggggaagttatcctaattcagaaggccatgggaggccacctgaagaagtgatatttagccgaaggtctagaatgatttggaggcaatcagggaaaatagagaagtttgcactctttgtgttcgagtctcaaatgccatccagggcgcctgtgtcttttcgttctggctgctgcctctacctttttctactcctggcattgccttgtggccttctgttcctgagcctcttctgtgtgtgcagggaggcagcaggttgtccagggtgataagaatggtaacgtcatagtaactactgtttattaagcgtttagtttcctgatctcattcagcagccctcagtcacagaaaatgaatgctgagttctcagagtttattgctgtctaagtgggcacgtaggccctagtcagggccctgccaggttcccagggtggggaaggctttctgtaccattacagatcacaagagttcaagaaaaaatgactttatgagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaa

SEQ ID NO: 377400 - DNA, 405 bp, Homo sapiens
ctgcacgcgggactggatgccttcctggtggtgggtgatgtctacaggcgtgaccagatcgactcccagcactaccctattttccaccagctggaggccgtgcggctcttctccaagcatgaggtgagtcttgagatgtttctcatcgctgaaggatgtcatagacattttatgttgaggtcactaacatttagctcgatgagaccagcatagtcatccttgcttgccttattttgccttagtgaatcatccatacttaatgacatcttgtgtataggtgtgccccagtactttttgaccgctttgttgtgttagtaactacagaaattggtaagccttagtttccagttgtctgtccttatcctttctctcaatactgacccgccattctctgggttacttctt

SEQ ID NO: 377401 - DNA, 797 bp, Homo sapiens
aggagaattgactaaatttcctggggaaaaaattcagactaggaaaaacttgttgaataccagctttagggacagtaaccctttctagttcatgttgaggctaattcagtagattagctcctctcctttggatgaggatttccctccccagggtttggttagaattccagggatgcaggcatggggtcgtttgggggcatgtcctagtgtgctgtttttatagactatatatatgtgtccatcagtcaacttatagtatggaaagttttcttctattcaaattgggcgatttggccacttcttgccaaatttcttggttttctgaatactgaaggttggagttgagcaactgcaggtcagtgattttcagaagaggggctcttgagcctgaggaatcaggtctcacgggtagcatgatggtctagcggagaatacttgtgttttccaggggctctcttgaccctcaggcctcaggcccctcttgaccctcatttagatggccgagttagtgtaatatggagaagccctcctctcagccccagcttcacaccacatgcagctcaatgatgataatgccttgatggacaaaatgcaggaggtctaaaagtgtccaggaaaacctaaatttgcttttgtctcctatgtttcatggcttagcttgtgccacttttgttcttcctttttcttgggcccattcttgggcttcgctgctaggtggcatgcctgtattgatacaggaaggaaggaagtggttagatcagcctattcatttctttatttaacctttatatcatcac

SEQ ID NO: 377402 - DNA, 367 bp, Homo sapiens
aagatcatcacatcacaaacagcagatgaaaaaatagcttcctgtgttcctatgaagacaggcactgtggttagtgatagctttcactgaactggatttcaggacagcagttagagattgacatcattacccttctgaatcaagaggcgacatgactgacatcacctttgagtttccagcctcctggtgatattgtttgctgcatcttacaccacatacctcagtcagcttactttgccctgcttccaggcatctgtgaaccatctggcctcttgacggatctggcatatttcatgtagagatgctgaattccaaaactgggcacctaaaggctgagcatgagggaacaggtcttctaatcaggtat

SEQ ID NO: 377403 - DNA, 662 bp, Homo sapiens
tttacagaatggaaattctacttatctggagtaggactatttccccagcctctagacacggaaagaataaccacacgcattggtcttcagtcaactattgttatacctttcaaaaatcccacaatggaagatgtcctcattgatataatactgacaagtgtggaacatcccaggaatcttgtcatggatcattgctgggatagcttcatctatgagagttctgccttcagatttagttctccgagtgaaatacaaggaattgcactgcctcctaaaggaaatatagatatctcattgttatttatacctcaaattatgaaattacacaaaacaatggttattattgagatgacgaaagcaaatggaaaatattggcctattgacaattttgatgagttggatataaaatttaaaagtattgtgggaatcgacagcgaagaaatccaagcaatacactggatataccctattgttggactcccacaagcaccacctcctaaatctcccccagttgtcatacaatgtcagtccaggaagcgggcagaagagaaggtagaaatcatactgaatgctggttttttcggatttagtcttactccagatctgacagaagttttagtgattccaaaaaagaaattcacataatttttgtgaggatccca

SEQ ID NO: 377404 - DNA, 556 bp, Homo sapiens
gctattgtttctgctgttaatcattgatcttcttcagttagggcatgaagaagatgattttttttcctcacaaattgatgtgaacagtctgtcactgtgggcttcatctttaatatcgtctcatcccttcttaaactgagttatccatttgtaaactgctgatttgtttggggcattgatctcataaacttgttgtaaagtatcaatgatttcaccattcttccacccacacttcaccataaatttgatacttgttcttgcttcagtttaattggggctcttttcaaactgatgtcttaaccttgttagtgccttaaactagatcctattcagacatgttataacaagttagtatgagtttgtttcagtgcaaaacattttgaacttcatgcatagttttttttataatacacattttccatgaacattttgaagacccctcatattttgcaaattaagtaaaatggtaacggatagtaatttaggcctcttgtcccttgaaaatttgtagacctatgaagattaaaatttaaaaattctaaaaaaaaatctgtga

SEQ ID NO: 377405 - DNA, 732 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377406 - DNA, 729 bp, Homo sapiens
cagaagcggtgtattgcgcctcagcatggaggaggacgtgaaggcgtacggagtctgggagtagtacaccacgtagattttggatataagtaatgtgcaggtttcttacatgggtacattggatgacactgaggtttggggtactgttgatcccatcatgcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377407 - DNA, 842 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377408 - DNA, 628 bp, Homo sapiens
cttctttgtaagaagaaccaggataatttgttcatttgtatagttgatccttgaacagcttggaagttcggggcactgacccccatgcagttgaaagtccacatataactttttgactccccaaaaacttgtctgagagtttcctgttgtctgaaagccttactgatagcataaatagcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377409 - DNA, 912 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcggcagtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377410 - DNA, 899 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatgaaacgtgcatcatatctgcaacttactcggttcagaagaaaagctcgggtgtatatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377411 - DNA, 940 bp, Homo sapiens
cacattgtgctgatccattgtctgttggactcttgggttgcttccatgttttaattattgtgaataatatgccgtgaacatgggtgttcaaatatctcttcaaaaccctgcatttaattcttatgaaaatatagccggaagtggaattgttggatcatatggtaatttcatttttaattttttgaggaactgctataccggtttccacagtggctatcccagtttacatgcccgcccacagtgcgcaggagtttcagtttctccatatcctctttagcgtttgttattttctgttttttttcagcagtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377412 - DNA, 1018 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggaactgctataccggtttccacagtggctatcccagtttacatgcccgcccacagtgcgcaggagtttcagtttctccatatcctctttagcgtttgttattttctgttttttttcagcagtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaatggcactagaacagttatattcagcgctgacacttctgattataatggaattattctaaaagtatctgctctttgatggctaccattctgtgtttaatgcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377413 - DNA, 616 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcggcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377414 - DNA, 465 bp, Homo sapiens
  misc_feature (3)..(3): n is a, c, g, or t
ggnccgctctagagtatcccctgagcccaggagttctgggctgaagcgatcctcctgcctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377415 - DNA, 1108 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggctgtttttcccttcctggattccctttaaattgtgacattcacctttactgtttgaagaactttttggagtactcagtgaagagtaatagtttgtttctttttttcttttttcttttgagactgagaccctatctctaaaaaataatattggccgggtgtggtggcccacgcctataatcccagcattctgagaggccaagacaggcggatcacctgaggtcaggagtttgagaccagcctagccaacatggtgaaacccagctctactgaaagtacaaaaaaattagccaggcatggtggcgggcgcctgtagttccagctactcgggaggctgaggcaggagaataacttgagcctgggagacggaggttgcgtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377416 - DNA, 530 bp, Homo sapiens
acacttcgagctggacccactttcagagtagctgtaggtaggaaagtaaacatcagaactagcctagtccttgttacgattagtactttggatttgatttttcctgtaaaacagatgcagtcatcttgtttgacctcagtaaccccagacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377417 - DNA, 678 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgatgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377418 - DNA, 660 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaattacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377419 - DNA, 830 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatggcactagaacagttatattcagcgctgacacttctgattataatggaattattctaaaagtatctgctctttgatggctaccattctgtgtttaatgcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377420 - DNA, 959 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataaaaaaaaaaaaaaaaccggggctcttttcgggggggaaagagctttgaagggcctggcctatggtccgcccttcggcagggaacatccgcgccctagggcgatcgaacggacggaacg

SEQ ID NO: 377421 - DNA, 1016 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagggaccatctggacttcctttggagatgtcttagcatattttaatgtagactatattttaatttgctttgtaacttattttattggcctgctacaaagtattatcttctgaagagtttcccttaagacccttctcaacctgattgctgggggcaatccagtagacgtgattaaagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377422 - DNA, 544 bp, Homo sapiens
caggcgggggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcggtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 377423 - DNA, 1034 bp, Homo sapiens
cccgccctctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatattaaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaagtaagtatttcttatttttgaaatgttagt

SEQ ID NO: 377424 - DNA, 299 bp, Homo sapiens
aagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggtagggcagggcgggcctggctggccgctttacgactccgactctccgggaggcccgggctgtccacagtgacgcttcccacatcccaccggcgggcaggggcg

SEQ ID NO: 377425 - DNA, 692 bp, Homo sapiens
  misc_feature (17)..(17): n is a, c, g, or t
aacacatcgagccggtnccagcaggctgggcccagattagatgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatattaaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaagtaagtatttcttatttttgaaatgttagt

SEQ ID NO: 377426 - DNA, 416 bp, Homo sapiens
aatcacttgaaacccaggaggcagaggttgcagtgagccaagattgcaccactgcactccagcctgggtgacagtgagactccgtctcaaaaataaataaataaattatactagaatattaaactattaaactaaaaataaacacagttttcctgttcttagaaggaatatgtattttcgggatgtaaatatggttaaaaaccagtagcttcttccctactatcaaagatccttaccttagactacttttagttccattctttttaaattttctttttatgtaaaacttttccttttttaaattttttgttttattttgagacagtctcgccctatcacccaggccggagtgcagttgcagtgggttgaggttgtgccactgcactccagcttaggcaataaaacaagactgtctc

SEQ ID NO: 377427 - DNA, 681 bp, Homo sapiens
actgattaagtgtgtctcttctaggataaagcaatttcacatgaagtccccccaaatggaaagatatcagctatctgtcattggaggccccagcacctataagcacatctcccccttggatgccagtgggcaaagattccgggaaactatggaggaattttctctctgagacagagcaagagagggagaccctgatgacttcttcgccccatgtcagcaggaagtagttacagaagacccacgacgtccttacaaccagagcttttcagggtctccatctcttgaggagggaaatattagggtaggcaggtaggcaggcatgagcaggcaagagagcccttgggaaaggaatctttagaaacgcagcccactgatagcttccttggtgatgctgcccacagacagtcagcacttctctaataacccatcctagaacagccttttgcttttttttttttttttttttttttttttgagacaagttcttgctctgtctcccaggctggagtacaatggtgcgatctcggctcactgcaccctccacctcccaggttcaattgattctcctgtttcagcctcctcagtagctgggactacaggcatgtgccgccatgcccggctaattttgtatttttagtagagatggggtttcaccatgttggtcaggctagtctcaaactc

SEQ ID NO: 377428 - DNA, 299 bp, Homo sapiens
atatgtgtggttgcgtgggagcattaaaataagctaaagaaccaagagatattgaagtctccccaaaatctccccccactgtactgtttgcaggaagtgacaggcttgagattgaaagacagatcttataccttgcatgctgtatccacgccaaaagaaaatcctctgcacacacacagaaatctaactggagccaaagaaatgggctaaataatttcataatgcttagaactaatatccacttacctgtgataaaggattcaagaagcacataatttatttatctatttatttttgag

SEQ ID NO: 377429 - DNA, 403 bp, Homo sapiens
tcagagcctcacctgacttgggtagaacacaaggaggtggatgaatagcatcgtgtggctggcggcttcccagatcacgggttttatctagtcttaaagcaaaacacaaaaccacctcctttctgccagtaggtggcactgcaggccggcacgcagctgctggcagtagtcaagtgattctacccactgatttacttttctctcccactgacttagtgctgcgctggactctccccacggttagctctagccagccaaaaaggacttcaggtgctctggaaatgtttgctaaatatgcccgagtgacgagccgattgctcttgccggcaattactgtgattgtgtgtatggatgcacacatattaagtttgtgcaacaggataaaaatcgtacacgtacgtgt

SEQ ID NO: 377430 - DNA, 576 bp, Homo sapiens
gtactctggaggcaaactgcttctgagcctctggagaatgggagagttttagtccagggctcaaccttcacctaccaggatatcctagctgggctggttgggtatgtgcctagtgtccctggcatggtcgtggatgagttccagttctccctcactgatggcctccacgtggacacagggaggatgaagatctacacagaactgcctgcaagtgacacacctcacttggctataaaccaaggcctacagctctcagcagggtctgtagcacgcatcacagaacagcacttgaaagtgacagatattgactcagatgaccatcaggttatgtacatcatgaaggaagatcctggtgcagggcgcctgcagatgatgaagcatggcaacctggagcaaatttctattaaaggccccatccgaagtttcacccaggcagacattagccaaggtcagccagttctcttctgcctaccaggcttccgtggactgcacctacactagtaaaatgagaattaaatatctggtagtctatggcaataaactgtgcactctttgttttgaggagcttcatttgtt

SEQ ID NO: 377431 - DNA, 528 bp, Homo sapiens
tgactcaagggaaaattagtaaattgaaatgtcggtactctttcactagggaaattataatttattcagctggaaactgagaagggcaagtgcctggtacctagatccaatgaatatgtgataatttagcctccagtctcctaaaatcatttgacatcccgttcaaaggaaatgttggggaataacctactctcttccgttctcttccaagggtctgtagcacgcatcacagaacagcacttgaaagtgacagatattgactcagatgaccatcaggttatgtacatcatgaaggaagatcctggtgcagggcgcctgcagatgatgaagcatggcaacctggagcaaatttctattaaaggccccatccgaagtttcacccaggcagacattagccaaggtcagccagttctcttctgcctaccaggcttccgtggactgcacctacactagtaaaatgagaattaaatatctggtagtctatggcaataaactgtgcactctttgttttgaggagcttcatttgtt

SEQ ID NO: 377432 - DNA, 264 bp, Homo sapiens
atatcgtcgacccacgcgtccgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377433 - DNA, 531 bp, Homo sapiens
  misc_feature (420)..(420): n is a, c, g, or t
  misc_feature (445)..(445): n is a, c, g, or t
  misc_feature (482)..(482): n is a, c, g, or t
  misc_feature (484)..(485): n is a, c, g, or t
tacaggtgtaagaggacggtcgattgtaagtcggcgcaaaccaattataacaataagatacagatataaaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcgcgcgcactancacatttggctaaattttgtatttnttgtagagatggggtttcgccatgttgcccaggctgntnntcttaagataaatacatctttaaaaaaagaaatagatcactttggt

SEQ ID NO: 377434 - DNA, 6136 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377435 - DNA, 6294 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagccagtgggacacctcacaagtcagctccgatgtcctcaggacaagactgctatagtcaccagtgctttgttgctttctggcgctccggtaggatccaggctcacttggtatatcccctgctgcagattacggtccacttctcccgggagctgctttcaagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377436 - DNA, 5874 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377437 - DNA, 5980 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377438 - DNA, 4989 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377439 - DNA, 5693 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacacaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377440 - DNA, 6799 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaaggtacaggccgggcgcggtggctcacgcctgtaatcccagcactttgggaggccgaggcgggagaatcgcttgagctcaggagttttgagaccatcagcctgggcaacatggcgaaaccccgtctctacaaaaaatacaaaaattagctgggtgtggtggcgcacctgtagtgccagctacttgggaggctgagatgggaggatggcttgagcctgggaggcggaggttgcagtgagcaactgtactccagcctgggcaacagagcgagaccttgcttaaaatcagtgttgaaaaattttagaagctaaataggtaaaaaagcaggaaggtgcagacctccactagtgctgctgctttatccatctggtcctgtgaaggctcaccctgaagctatgggatggctgcttttgtttcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377441 - DNA, 5630 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacatgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377442 - DNA, 6044 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377443 - DNA, 3625 bp, Homo sapiens
ttcatacaaaacctgctgtaaattaagacaaaggtagattaaaatgcgtcattgtctgtctctttaaataaagtaatgctttccataaaaagcaaaggtgggcttttgccttgatgccgaacaacgcagtctctagaattttgtgcaattctgcacaaaaatacattctctgaaaaaattgttttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377444 - DNA, 5490 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatactgatctataggagtggtggggtaccgagctcg

SEQ ID NO: 377445 - DNA, 5350 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaaaactccccaaaatcttgggttggaatgcccttttggaccagtgattggaaaaaaccgatttttcaacccacccttctggaaaatcccc

SEQ ID NO: 377446 - DNA, 5460 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttgctgtgctccgggtgggtacaggggctcagcctctgaggatggtgacctggtttgtaactgtccctttacccacaccaggagagagaaataaggaacagtcccctgggaggtgtccaggaccaggagggcacaggaagggaattttaggcatctaaggattcttatttccagtatgaaatctattcaagacctttgctgtcctcctgtggatgcag

SEQ ID NO: 377447 - DNA, 5454 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctatttatattgaagttcacaaataaggttggaaaaaccaaatttttttttccagggaaggaaatgggtaatttctttgggttgggcaagaaaattttgggcaccagggggaaaaaacttttcccttagagggaagagcaaaccccaaggcccgacatgttgaggaaattttcacacgcgggggggacgccaaaaattttccggaaaagaggggcgtgcggtccacaatataaagaaaaaaagagggcggggccccccacccacaagaaaagaaccccccctgtttttttttttttgtgtgggggcgcaccccaattatatagtatgtgagactgtgctacaacacgctgggggggcgggggacaccaaaaccacacgcaggggcggtccccaaaattttttttataaaccagattttt

SEQ ID NO: 377448 - DNA, 2860 bp, Homo sapiens
  misc_feature (1)..(1): n is a, c, g, or t
  misc_feature (8)..(8): n is a, c, g, or t
  misc_feature (16)..(16): n is a, c, g, or t
  misc_feature (55)..(55): n is a, c, g, or t
  misc_feature (60)..(60): n is a, c, g, or t
  misc_feature (90)..(90): n is a, c, g, or t
ncaaaaancggccaanttgaagtgccgttaggtgtccagacatgggcttgttccnttggngtccttccgacaacgccaagtggttccagnccaaagccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377449 - DNA, 2799 bp, Homo sapiens
cacgcatacacacacacactcatgcacacacacactcttacccacgcattcacgcagacacacatgcacacacacactcctcacatacccacgcattcacgcatacacacagacacacactcatgcacacacacactcgtatgcacactcagtgacacacacattcctcaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377450 - DNA, 2586 bp, Homo sapiens
actccagagggtacaccgccgcccggcagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377451 - DNA, 3186 bp, Homo sapiens
catacctggaccttctgaaactattccaagaaatcgaagaggggggatatctctctaactcattctatgaggccagtatcaccctcggagaaggtccaggtatccggcatgcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaaggtacaggccgggcgcggtggctcacgcctgtaatcccagcactttgggaggccgaggcgggagaatcgcttgagctcaggagttttgagaccatcagcctgggcaacatggcgaaaccccgtctctacaaaaaatacaaaaattagctgggtgtggtggcgcacctgtagtgccagctacttgggaggctgagatgggaggatggcttgagcctgggaggcggaggttgcagtgagcaactgtactccagcctgggcaacagagcgagaccttgcttaaaatcagtgttgaaaaattttagaagctaaataggtaaaaaagcaggaaggtgcagacctccactagtgctgctgctttatccatctggtcctgtgaaggctcaccctgaagctatgggatggctgcttttgtttcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377452 - DNA, 2077 bp, Homo sapiens
tccccctccccgcacacacctacggctaggtacgaggccgcgtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377453 - DNA, 3729 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcgtctctctgccttcggctatacatcagatcctaccatgcata

SEQ ID NO: 377454 - DNA, 4081 bp, Homo sapiens
  misc_feature (4079)..(4079): n is a, c, g, or t
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaaggatggagatgaagatgaggaagctgagtcagctacgggcaagcgggcagtgaagatgaagaggatgacgaaagtcgattaccaagaagcagaagacgaggagggatgactagacaggcaaaaaaggaaaaggttaactaaaaaaaaaaaggggcggacctataacctcaattccggttcagaattaagtggtacctcgattaaaaggcgcgccacgggatggaccgaaagaaggttccaacaacaacaggaatgaggggggaagaacaaatcgggcgtttttaagttaaggagggttttaattggaatgggggcttgttgaaatggtgtttttggggttaaagttaattctgttgttgtaataaaaagngg

SEQ ID NO: 377455 - DNA, 1213 bp, Homo sapiens
atatgatctagaggatccctactactacgagagcaaatcaactacagtggtagtggaggccgaagcggcgggaacagctacggctcaggcggggcatcctacaacccaggtcacacgggggctacggcggaggttctggggggggctcctcataccaaggcaaacaaggaggctactcacagtcgaactacaactccccggggtccggccagaactacaggggccctcccagctcctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgc

SEQ ID NO: 377456 - DNA, 774 bp, Homo sapiens
  misc_feature (19)..(19): n is a, c, g, or t
  misc_feature (64)..(64): n is a, c, g, or t
  misc_feature (66)..(66): n is a, c, g, or t
  misc_feature (73)..(73): n is a, c, g, or t
  misc_feature (75)..(75): n is a, c, g, or t
  misc_feature (120)..(120): n is a, c, g, or t
  misc_feature (124)..(124): n is a, c, g, or t
  misc_feature (128)..(128): n is a, c, g, or t
  misc_feature (131)..(131): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (155)..(155): n is a, c, g, or t
  misc_feature (197)..(197): n is a, c, g, or t
  misc_feature (204)..(204): n is a, c, g, or t
  misc_feature (239)..(239): n is a, c, g, or t
  misc_feature (245)..(245): n is a, c, g, or t
  misc_feature (259)..(259): n is a, c, g, or t
  misc_feature (282)..(282): n is a, c, g, or t
  misc_feature (287)..(287): n is a, c, g, or t
  misc_feature (291)..(291): n is a, c, g, or t
  misc_feature (300)..(300): n is a, c, g, or t
  misc_feature (304)..(304): n is a, c, g, or t
  misc_feature (312)..(312): n is a, c, g, or t
  misc_feature (316)..(316): n is a, c, g, or t
  misc_feature (321)..(321): n is a, c, g, or t
  misc_feature (328)..(328): n is a, c, g, or t
  misc_feature (352)..(352): n is a, c, g, or t
  misc_feature (359)..(359): n is a, c, g, or t
  misc_feature (379)..(379): n is a, c, g, or t
  misc_feature (384)..(384): n is a, c, g, or t
  misc_feature (406)..(407): n is a, c, g, or t
  misc_feature (424)..(424): n is a, c, g, or t
  misc_feature (440)..(440): n is a, c, g, or t
gtggaacttcttcaaaaanggtattcaaaaaacttgttgctttcccatttattttaggttgcanangaaaacnanaacaagggctttttataggtgggtaggatagacggtggaaaattntttngcanatntctttatanttnacnaggcttgcnatgatggcgattggggatttcttgggattttttttttggttngcgtttnttatgttttatattggggacttttaaaaaatgtanattggngggaggatataganacacgtggattgtttcccttgtnttctnccangtaataganactnggctcttntgcnttggngcgagangttgttttcttgtctgtgtttttncttgctnctatttttttcttattaggnttttnttagttttttcctattttcatnntatttttttttttggtntttttgtttttttttnttttttttttttgcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377457 - DNA, 586 bp, Homo sapiens
gtatctacaggatctaaacaccgcaatctatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgc

SEQ ID NO: 377458 - DNA, 289 bp, Homo sapiens
catggacaaggcagctactcctactcgaactcctacaactctcccgggggcgggggcggatccgactacaactacgagagcaaattcagtgagttggcttccagagcccctcggccgggccagggtccaggccccagcagtgcagcccacggagtggcagaagctcggcactgcccagacctctggctgagggccttaggaggaggacaagtggtgctggctgcgggcgggtgctaggaagatggggcgtgggacctcatggtgccgtctccgccactctctctggtgt

SEQ ID NO: 377459 - DNA, 378 bp, Homo sapiens
aattcagcttctgggaaactcagctgccctttagaaagctgccacatcccctttccacctgacagaaaccccttggtcaaactgtgccttgtcttcttattccatccatgaatagaaacgctatcagtcaacgaccccccggacgttctggacaggcagaaatgccttgctgccttggcgtccctccgacacgccaagtggttccaggtttgcattttgttcttctatttgtcttttggtagagaattcctaagttttaacttggctaactgtcaccataaagattccttaacattgacgatagccgtgccgagcttagcacctgcagctgcgcaggtcctaaaggagtgcacctcaacaaattcgaccccaaaagag

SEQ ID NO: 377460 - DNA, 450 bp, Homo sapiens
gggccccttcccatgtgatccctaccaccgttccccagaggctgtcccatcactgattagtttcgcttattctagaactttatgtaggtggaagcatgattctttttgaatttgttccaaatgtagccagtgggacacctcacaagtcagctccgatgtcctcaggacaagactgctatagtcaccagtgctttgttgctttctggcgctccggtaggatccaggctcacttggtatatcccctgctgcagattacggtccacttctcccgggagctgctttcagtaggtttttgttgttgttatatttttgtttatttatttatttcgagacattctcttgctgtgtcaggtaggctggagttcagtggtgcaatctcggctcatggcagtctcctccccagttcaaggaggtcaaggagttcaagaccagcctggtgaacatagtgaa

SEQ ID NO: 377461 - DNA, 652 bp, Homo sapiens
gtctcgatctcctgacctcgtgatccactcacctcggactcccaaagtgctgggattgcaggcatgagccacggctcccagccctaccattgcatttttaagcaccgtttggaaatcgcttctttcactagttatccctctttcaagtacccaaaacgtggccaaagacctggccaattagagagaccctgacatcccaggtgaaatcacttccgggtcatcatactcaagacgttggcctttctgttgcaggaataggtggagccagataaaattgttgattgctttgaggagaaagtgttttgaaagttgcattttattttttaggctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggtagggaggccgagacacgccggcaggactttgaaaatgtggtgttccctcactattcaaatgtgctattcagttttagactgctttggtatacggtgtagattgaccacctttactctgagatcacatctcccgttggctttgagtacttgggagtttgacaaaacagtcgcacta

SEQ ID NO: 377462 - DNA, 527 bp, Homo sapiens
gagacacgccggcaggactttgaaaatgtggtgttccctcactattcaaatgtgctattcagttttagactgctttggtatacggtgtagattgaccacctttactctgagatcacatctcccgttggctttgagtacttgggagtttgacaaaacagtcgcactaaaagtgagtagcacttttcataggggactgcaccattttcctttatcttcatccttgaacgttctcaaacatgaatgtggaagttgcttttctatggagccattctctggctgtggagaagtgtccctggtgattccatggttttaaagatgagacaaccagatggtttctgcatgagcaccacgttggagtttaccaacagcctgtgctgcagctgagctgagggcctcttcgtttgtcctctgtcatggctcttttatcatttaaagtgacagaagcacaaagagctgatacagagttttggataaagttttaaactgttgtccaatttttcaaaccacatcattggacctcacgctaa

SEQ ID NO: 377463 - DNA, 6078 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattgcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377464 - DNA, 5248 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377465 - DNA, 5947 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgc

SEQ ID NO: 377466 - DNA, 6581 bp, Homo sapiens
  misc_feature (4932)..(4932): n is a, c, g, or t
  misc_feature (5059)..(5059): n is a, c, g, or t
  misc_feature (5062)..(5062): n is a, c, g, or t
  misc_feature (5083)..(5083): n is a, c, g, or t
  misc_feature (5213)..(5213): n is a, c, g, or t
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggccctngacccccaccccttcccggccccacagtgggattgattgtgttaatacacgaactcgtgtaactgcaaagttccttaaaagttagaattttaaatttctctgctttaagccatgcgaagcaccaatnttntgaatacgcttttccggccantgcacagctcttgtcttgagaaggagccttcattggggggttacaggagcagagaaatctaaaacatgaatttcaaatgtggcgctctgtgccctttttcaaaagaattctaatttcttctctctgctcngtctcccccttttgtaggtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377467 - DNA, 6289 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagaaaaaaaacgacaacagggggggcgtccaaaaatacatgaggggccaaattagcgcgtcccgctttgtcaacgggcccaaggggtgtattatagaagacgggcgcgatacaagcagacgggacaagcgacgggatttggagaacacttggggg

SEQ ID NO: 377468 - DNA, 6038 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377469 - DNA, 5946 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377470 - DNA, 5232 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacacctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgc

SEQ ID NO: 377471 - DNA, 5386 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctcttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377472 - DNA, 5104 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaactaatcgagacagctgggatctctag

SEQ ID NO: 377473 - DNA, 4369 bp, Homo sapiens
  misc_feature (4258)..(4258): n is a, c, g, or t
  misc_feature (4283)..(4283): n is a, c, g, or t
  misc_feature (4320)..(4320): n is a, c, g, or t
  misc_feature (4322)..(4323): n is a, c, g, or t
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaaggtacaggccgggcgcggtggctcacgcctgtaatcccagcactttgggaggccgaggcgggagaatcgcttgagctcaggagttttgagaccatcagcctgggcaacatggcgaaaccccgtctctacaaaaaatacaaaaattagctgggtgtggtggcgcacctgtagtgccagctacttgggaggctgagatgggaggatggcttgagcctgggaggcggaggttgcagtgagcaactgtactccagcctgggcaacagagcgagaccttgcttaaaatcagtgttgaaaaattttagaagctaaataggtaaaaaagcaggaaggtgcagacctccactagtgccgcgcactancacatttggctaaattttgtatttnttgtagagatggggtttcgccatgttgcccaggctgntnntcttaagataaatacatctttaaaaaaagaaatagatcactttggt

SEQ ID NO: 377474 - DNA, 3955 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggaagaagaggaaagaagaaaagaagaggaaagaagaaaagaataaggaagaag

SEQ ID NO: 377475 - DNA, 2412 bp, Homo sapiens
gagctggaactgggcacacgccatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccggaacgcagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377476 - DNA, 4037 bp, Homo sapiens
agactttcacgggaaacaggaggatttatttagatgtacaccggctcagtggatttgtatctgaaaagctgaccattgaacaaagactgagtgtggtttttataggcaaacttacagaagcaaaacaaaagcagttaatgatacagtcacaggtcatgtaatctatagcataactgctgacttagcataacttgtggctttgcacagctgttggccttgcagctgtgtcaaaagaaaaacagagtctacaaatcttactaaatacaaccattggcaaacagtcatatttaatggttcagaaaaggagagacagtaaaggaatttttcttttcaactttgctccggaggaggctgtctggagcccattcctttggcctcgacttttcagtgttataactgtccttgaagtaagctggctaagcagaggaaaacttgttcttgttttctttttaacccttaccccctgccacataatcacatctttacacttcttttttttttttttttttttttttaagatgggaagtcggagtctcgctctgtcgcccaggctggagtgcagtggtgccatctcggctcattgtaacctctgcctcccaggttcaagtgattcaagccattcttgtgcctctgcctcctgagtagctgggattataggcgcacaccaccacacctggcgaatttttttttttttttttttttgaggctgagtctcactctatcgcccaggctggagtgcaatggagcaatctcggctcactgcaacctccgcctcctgggttcaagcgatcctcctgtctcagcttcctgattagctgggattacaggcgccctccaccacacccagttaatttttctatttttagtggagacggtgtttcaccatgttggccaggctggtctcaaactcctgacctcaagtgatccgcccacctcagcttcccaaagtgctgggattacaagcgtgagccaccacgcccagccaggaaacccattttcaacacctccttgctcttttttttttctgagacagagtctcgctctgtcgcccagactggagtgcagtggcgcaatctcggctcactgcaacctccgcctgccaggtcaaacaattctcctgcctcagcctcccaagtaggtgggactacaggcatgtgccaccacacccggctaattttcttttgtatttttagtagagacggggtttcaccatgctggccaggctggtctcgaactcctgacctcgtgatccgcccgcctcggcctcccaaagtgctgggattacaaacgtgagccaccgcgcctggccttccttgctcttcttgctccaaatcctgggaacgtctgaatcaacaggcggacatctgtcaaaccttcctagcaactacgcctgcggatggccaacctgaccctggaagacagtggggtttagttaagcacagattgtacatcgggggcctcataaggcgcctggaagcattcaagaacaccacgcttgtaaggacaaagcactcggtcacgggcgcctttacttcggagctccgcgctgctgctggacgagcgtccgttgagtcccagccccaatttttccaggaaatggcggtgagccctctagtgagatattttttggcctgggcctcagtttctccatctgtcaatgggggaagggtaaggcgggctagaggaccccgaccaggtcggctgcagccttcggaagctacggcccagggacgccacaccaaggcaggtctgcgggacgaaagaacccaagaacccgggcgcgcattggcgccggtcccgggctcaaggggcagcaacgaggagacgctggacctggccgttcctcgcacacatctctaaccttctgtgcctctcaagggagatggggtgagcatagccacctccactggagcccgaaaatccccggccgagataccgccactaaaaaggtacacatgcgtcaaagcctctcggagccatttccgctaacgtactcagggcgacgggcgtaagatggcggccgcgcaggcgcaaaatgtcgcagccgtagggaggctccgcctctgacgcttgccttgcatcacgtggtaatggccgctcaaaaaacgccttagcgaaaaccagagcgtgccctcgtcacgtgatggaggactcccagtacggcaaagggaaggcgccaaaagttgtcagatggcgaaggaaaccgcgaaattcgccattgtcacatgatggagcaacctatcgaaagcggagggaaaggtgccgaagtcacgtgactacgcacgcaaacactcccgcttgcaccacgtgcaactcacgcccaccccctcagccccccccttatctcttttcgcccctccctcccatttgggttgggcctgcgtcgaggcgcaacgcggcgtcaaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaaggaggaggaccaccagaaaagagtctcatcgtggaaggcagagggaccaagaacaacagtagagaggttgaccatgccagtctcttccttacagagaagagccatttacaattgcacaaggaaggggccgacactttgtgaactgagaggatacctttttctaggtagaagaacc

SEQ ID NO: 377477 - DNA, 1593 bp, Homo sapiens
tgtaacggagaggggacggaaaaacgtagctgagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaag

SEQ ID NO: 377478 - DNA, 1664 bp, Homo sapiens
gcgtgaaccgcggctgggggggaagcttgaaaacgacggaagaagggcgttgagcggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactctgcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgc

SEQ ID NO: 377479 - DNA, 323 bp, Homo sapiens
attcctatcagtgtcaggttcaagtcaagggtttttcttgtcaacactatgtaacattattatggaagtgttggtgacagttattaaacaagaaaatgaattaatggaattattgagggctatagagtgctaaagagcactctgtagtgtgctaaacagcacagctccttagcttggctataaaaacctttttagccttatctttcatcgtaccaccaccaccatcagctgggactaggtgtcatggtatcagtttctctcaaagcagtggttttcagacatggatggtgtatgtattaatattacttttaaagaaaaaaaat

SEQ ID NO: 377480 - DNA, 1933 bp, Homo sapiens
acctcgcgtacggtggctggcgaggctcagtacggtgtgtggagctggagcaccgtgaggaagaagcgaggttctttttaagagttcagctgcgaggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaatgg

SEQ ID NO: 377481 - DNA, 837 bp, Homo sapiens
acctcgcgtacggtggctggcgaggctcagtacggtgtgtggagctggagcaccgtgaggaagaagcgaggttctttttaagagttcagctgcgagatatcaaacaaagaattactctgtacaaagccagaacacatatatcaaagtaatcctgaagtatcagaacaaaataatagatgagtctcgctctgtcaccaggctggaatgcagtggcgtgatctctcactgcaacctctgcctcccgggttcaagcgattctcctgcctcagcttcctgagtagctgcgactacaggcatgcgccgccacacccagctaatttttgtatttttagtagagacggggtttcaccatgttggccaggatggtcttgatctctttacctcgtgatccgcctgccttggcctcccaaagtgctaggattacaggcatgagccactgtgtctggccatgaactctgtttctaagcaacttatataaatctctccctttctgccaataaaagcttccttttccccttctgtcaccagatgtacttgtggcttgcccttctgtgcatcctggattataatccttttctctcattctcaaataaactcaacatgtttggaggtaaacacacccccaccaacccaaacccacacaccccacccccacaccccccctccccacatccaccccacccacacaacgaaacaaactcttgggggcggcgctcggtacccctgaaaagatctttgacaccacttctgtgggcgggaggacggcgcaccagatcgttcacacaccagcgtccctcacaaggttcacagagggcatcgcgccccacacatgtcgtc

SEQ ID NO: 377482 - DNA, 2013 bp, Homo sapiens
acctcgcgtacggtggctggcgaggctcagtacggtgtgtggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaatgg

SEQ ID NO: 377483 - DNA, 2170 bp, Homo sapiens
acctcgcgtacggtggctggcgaggctcagtacggtgtgtggagctggagcaccgtgaggaagaagcgaggttctttttaagagttcagctgcgagccaaggttcactctctactccctcgtcacgcgtcccaacttctcatccagaacccacccctcttgcagcccgctcagctccactggcttccccgtcagaaacctgaattacctaaaatagtagtaagaagggtgctgcgaccctacaaagtgatcaaatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaatgg

SEQ ID NO: 377484 - DNA, 1930 bp, Homo sapiens
gctggaaccttgaagaagggaagcctgctcttgataacaggagagattttcttcatttgaatttctgactcttgtttcctctttttttttcaggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaatgg

SEQ ID NO: 377485 - DNA, 1144 bp, Homo sapiens
caagtcagcagctccccagtatctgaaggatcaagccagcacctcagcatagagcctgagacccttccatgtgcctcgctccttccagtttcatccctgcagccctttgctccagccaagtcacctggtccctctgccacgtgtgccttctctgctcctagcttgtcccttctcacccttttggcatctggtgactcctcattttggggacctgggcctatccagatgtcagcaggaggctccatagtcatgtgcagctaagggctctgctgcgctttgctttaggtctgtgacagctccagacacttgaggtcattgtgtatttgtgcctttctccactgggcacttttgcttgggaggagcatgtgatacaggcagccttcatttgacttaggttggaaacacttccttttatctgcctttgatttgaccccagcagtttggcctacagggctcatttctctggccatgtgattccttttctctttgtatcaggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaatgg

SEQ ID NO: 377486 - DNA, 1271 bp, Homo sapiens
acctcgcgtacggtggctggcgaggctcagtacggtgtgtggagctggagcaccgtgaggaagaagcgaggttctttttaagagttcagctgcgagatatcaaacaaagaattactctgtacaaagccagaacacatatatcaaagtaatcctgaagtatcagaacaaaataatagggccttgctctgtcacccaggctggagtacagttgcacaatcatggctcactgctgcatcgaactcttggactcccaatgattcttctgcttaagcctcccagagtggctgggactgcaggcaccttccatcactcctggctagttaaaaaatatatatatatttttggtagagatgggatcttgctatgttgcccaggctggtcccaaactcctggccttgagtgatcctcctgccttggcctcccaaagtgatgggattacaggtgtgagccaccttgcctggcatagacattttttaggactattgtaattcagataaaatgctctggaaagaatacttgcccagtaatggcatctccaccagtgaactgaagacaactctggctttgatcctctaggaaactcatgaactcttttttttcttttttggagatgagtctcgctctgtcaccaggctggaatgcagtggcgtgatctctcactgcaacctctgcctcccgggttcaagcgattctcctgcctcagcttcctgagtagctgcgactacaggcatgcgccgccacacccagctaatttttgtatttttagtagagacggggtttcaccatgttggccaggatggtcttgatctctttacctcgtgatccgcctgccttggcctcccaaagtgctaggattacaggcatgagccactgtgtctggccatgaactctgtttctaagcaacttatataaatctctccctttctgccaataaaagcttccttttccccttctgtcaccagatgtacttgtggcttgcccttctgtgcatcctggattataatccttttctctcattctcaaataaactcaacatgtttggaggtaaacacacccccaccaacccaaacccacacaccccacccccacaccccccctccccacatccaccccacccacacaacgaaacaaactcttgggggcggcgctcggtacccctgaaaagatctttgacaccacttctgtgggcgggaggacggcgcaccagatcgttcacacaccagcgtccctcacaaggttcacagagggcatcgcgccccacacatgtcgtc

SEQ ID NO: 377487 - DNA, 402 bp, Homo sapiens
accatgagggcggagggcttctggcgattggttacctggttcctgggattctctttagttgttcctcattgccctgagatagcttgtcccgtgctggtatccgaggttgcagctgttttcccagatgtgttccctgcgcagggtctggtaatccgtgtttattgagagtttgaatgaatgatcaggcctaggggccgagacaggggtctgaagtcatagatctgggctcaacccctcaccctctctgtctgtgagcccagagtgcaagctgatggctttcagcttcttctctctctcaagtgggagataaggtcttcaggttttatttcaagttgggtcatcttttcttcacagttattttccttccttttaagccaaggttcactctctactccctcgtca

SEQ ID NO: 377488 - DNA, 382 bp, Homo sapiens
tgtagagttgagtcttacgttgcccaggctgctcttgaactcctagcctcaagcagtcctcctgcattggcctctcagagtgctgggattacagatgtgagccactgctcctggccagtggtggttcttcttatgggggtcacattgccttggctacacatacatctctggtgccttcttggagctcctttccctgccatcagagcatagcccaggccttagagcctgcctgggcatcaggcaagtcatttcttttctcaggcggtgcagtatgacaaccactacaccaacaccaagtactgcttgtgccagatgctacgagaacagctggagtcgccccagggaaggttgctccatgctgcccagtcttcccgggaaattt

SEQ ID NO: 377489 - DNA, 777 bp, Homo sapiens
  misc_feature (34)..(34): n is a, c, g, or t
ggccgggggtaaatcggccgagggcgaggtcttnttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggagaagcggacgacgaactaagaatcctgatcgatgggaagtctcaaagcatggtgaacacaccatactgaatgc

SEQ ID NO: 377490 - DNA, 1971 bp, Homo sapiens
acctcgcgtacggtggctggcgaggctcagtacggtgtgtggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctca

SEQ ID NO: 377491 - DNA, 1924 bp, Homo sapiens
  misc_feature (34)..(34): n is a, c, g, or t
ggccgggggtaaatcggccgagggcgaggtcttnttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgagaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaatgg

SEQ ID NO: 377492 - DNA, 449 bp, Homo sapiens
tgaagatgcaccaatgtttaacaagaaaggaagggcagtgtagaacacctattgctttctgcatggtaagagggatgggtattgggagagcccacacctgctgaggagtgcctttagactttgagcggtggtgtttctctccctcccagaaatagatctctttggggagacaggccatacaagacgtgaatctggtgacattttacttgtttgaagcaaaatttttttagatgatggagggtttttaaaaattgcttttaaaattaaaatttgaatagataagaagtaatcactataaaaaataatgaagcataaggaatgctagtattagctgggtgtggggcactcacttgtagtcccaactactggagaggctgaggcaggaagaatgcttgagcccaggagtttgagtccagcctgggcaacataacgagaccccatcttttaaa

SEQ ID NO: 377493 - DNA, 1221 bp, Homo sapiens
aaatcgtttcttttcattgccagattttaaaagtgttcttttctctggtgatataagggttccatgcaggggtaaagttatatttgtgggtgattcacttaaaaaatctccatatcatccctaaactggagcaaagaagtggaatgaataaaggagaattatttcacacaacctatgtgctgcagatggctgtatattaaaatcaagttgtgagtgtaatattcccttttcctgatacatcattattcagttgactgcttagagtaaccctttcttatgtatgtttcttgttctggagttttattttcttgcatttgttccacaaccgtttattcaacacctttacgtctaacatgtgtttatgtctaacactcaaagaaggagtgccttcctggatatatggttacagaattatttcaggaagtcaattgcatttgcatatagagggattttcctgcaggcctttaactttagaatttactttgtgcctcgtgttaggctttgttattggaatagacgggaattttcatgtggaaatcacgggctgcagagaaggaggccgagtgagtgacaggctccttcacggtgatacggccctgctgcaggagtggaagggacttctccagtgaggtcctcttcatctgaaacttgacggataggcaagagtgtgctaggtgggataaagtttgaaggtccttagtaacacaggaggacagagtgcgtcacacagctggggacgagggagtgatgtgtggagagatgcctggaggggcacatgggggcagctgtgaccaaggccctgaagctgcagttaagggtcggacctcagccttctcttcatccaaaacagatccctgcgtttggaaactgtgaaaaccttttcccatcagagatctgagcaggtcatatttcatgagatttgttcaaatccaggccgggcacagtgctcacgcctgtaatcccagcactttgggaggctgaggcaggcagatcacaaggtcaggagttcgagaccagcctggtcaacgtgatgaaaccctgactctactaaaaatataaaaaatcagctgggcatggtggcaggcgcctgtagtctcagctactcgagaggctgaggcagaagaatcgcttgaatccaggaggcggaggttgcagtgagccaagattgagccactgcactccagcctgggtgacagagctagacttcatctcaaaaaaaaa

SEQ ID NO: 377494 - DNA, 373 bp, Homo sapiens
tcacttccttaaagtctatgtgtgaagtattgtcctgcaatgttaataatgctgttttctttgttatctacaaatcatcacaaaacggtaataactgttcaacagttttttaaaaaaattaatgaaatataagctatacacccaaagttgaataagatctgcaaacagctcttgaaaatagcataaaatattttgagctttttatacttatatatttgtatttttaatatttgaagaaaaactgagaatcatcttaataactttattatattttatgtttcaatccatcctagcctcttatctttgctcctgatctcacaggcctatattataggatagaaagtctttgttcagtgtttttctttggtttaat

SEQ ID NO: 377495 - DNA, 394 bp, Homo sapiens
gttatatatatgcatatatatgaaatatatattaaattaaatagttggcttttgcaatacatattacatatttttatatattatatgtatatttaaattatataggataatgaatgtaaaatagaatgaagactctagattatataaagtataaattaatctctaaatttcatcaacatgggagaaacaatcactacgccagtctgtaaattgcatgaggaacgcagggcagtctgtactgtatacagttatcatcaatgtctagcagagtgcctgacacaaaaatgcataataaacatttttagatgaacaaataattgatatgattaaaacccaagcaaaactcccagattatctagaaattcacaatgatagctagaggaaacctggtatc

SEQ ID NO: 377496 - DNA, 176 bp, Homo sapiens
tgaggttgggagttcaagaccagcctgaccaacgtggagaaaccctgtctgtagtaaaaaaattcctatccacaagccaggcatggtggtacatgtctgtaatcccagctatttgggaggctgaggtgagaggatcatttgagcctaggactttgaatccagcctggacaacatag

SEQ ID NO: 377497 - DNA, 2056 bp, Homo sapiens
  misc_feature (41)..(41): n is a, c, g, or t
tggccagtactatgcggtttatggtagcgaggcctgggttntgcggagcttccaggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377498 - DNA, 2057 bp, Homo sapiens
cgcgcagcggtgcagggcggaagcgctgccaggcgtccggagcgcggagcttccaggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377499 - DNA, 2482 bp, Homo sapiens
  misc_feature (41)..(41): n is a, c, g, or t
tggccagtactatgcggtttatggtagcgaggcctgggttntgcggagcttccaggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggcaaaaaaaaaaaaaaaaaaaaaacaacaaacaacaacaacacaaaacaaaacaaacaaacaacaaaaaaaaagaaggggggggggcgcgcgcgtataaaaaagaataacccgcgggggggcgcccaatattagcgcggataaccccgggctctttttaggaccaaagggggggcgcccaataagaggagggcggttataaaaaggaggagagcagcggggcgcgatttaacacaaaggctgtgtggtggggaagaactcgctatgtggggaatctgtgggggaggaaccctcttctgggggggggactgttgttgggcgcacatctacgcagagaatttaagcgctagggaaatattaacatgggggttaagtgttaaacaggggatttgttgggtgagaaaatgggtaggatagtttggaatttcc

SEQ ID NO: 377500 - DNA, 1868 bp, Homo sapiens
cgcgcagcggtgcagggcggaagcgctgccaggcgtccggagcgcggagcttccaggtctctgggtcgccagcgcgcgggcgcgcggctggagccggcgccgggcacggcatcgggggcctggactgcacggcccggcagcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377501 - DNA, 1954 bp, Homo sapiens
cgcgcagcggtgcagggcggaagcgctgccaggcgtccggagcgcggagcttccaggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377502 - DNA, 2505 bp, Homo sapiens
  misc_feature (41)..(41): n is a, c, g, or t
tggccagtactatgcggtttatggtagcgaggcctgggttntgcggagcttccaggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggtgtgtctggggtgggcggtgtcctggtggtgacagaagggaaactgaggcacagggccacgaagcttatgttgggccaccctgagcatcagggcagagctggcaacaagcactcctgcgttcttaactccacgccctgcagcctctcagcttctcacctgacacagggtccctgctggctcctgactgattccttgggggtctggctggcctagattctccaggaccgagcaccaccctggccctgtcctcaccagtggtgacctgaacacaatcttctgtcctaaatactgtcatcctcactcatggcaggggacagggagagttccaccccaagaggctgcttcaagactgcagcggggtcatgacgggaggtgggtcctggtcagggagataggtgtggatcggccccgctcccagcttgatccggcaccgccctcatcccgcaggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377503 - DNA, 1554 bp, Homo sapiens
gcgagcggccggacgcgtgggtcgcccacgcgtccggtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377504 - DNA, 2297 bp, Homo sapiens
  misc_feature (41)..(41): n is a, c, g, or t
tggccagtactatgcggtttatggtagcgaggcctgggttntgcggagcttccaggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggcaaaaaacacaaaacagagagaaagaagaacagagagaccgaggaccgagacacaagaaagaggggggggaacaaagaagaagtaccaagaggaggcccaaggtgaggacagcaggaaagtgtggagaaaagggggacccaaatagaaggggactacaacgggacagggagacgggctacaacacgtgtgtgagcggaaaaaagctaaagtggacttctggagaggcaccacactagggaga

SEQ ID NO: 377505 - DNA, 1957 bp, Homo sapiens
  misc_feature (41)..(41): n is a, c, g, or t
tggccagtactatgcggtttatggtagcgaggcctgggttntgcggagcttccaggtctctgggtcgccagcgcgcgggcgcgcggctggagccggcgccgggcacggcatcgggggcctggactgcacggcccggcagcagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377506 - DNA, 2134 bp, Homo sapiens
  misc_feature (41)..(41): n is a, c, g, or t
tggccagtactatgcggtttatggtagcgaggcctgggttntgcggagcttccaggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggtagggggggcggccggagccccacggtggcgtctgtggaggaaagtggctcagactctggactctgtcccactccaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377507 - DNA, 1896 bp, Homo sapiens
  misc_feature (41)..(41): n is a, c, g, or t
tggccagtactatgcggtttatggtagcgaggcctgggttntgcggagcttccaggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggc

SEQ ID NO: 377508 - DNA, 229 bp, Homo sapiens
cttgctgagtgtactcactgacacatcccataagtacttcttgcttgatatatccagaatggagctcactgtttctcctgcatctcttcttcctcattcattctctttcagaatgggagcagctgtcttcacaggccccacgctgtgatgaggggacttctcatcttttatctccagatgatcaccaagttcagctaattttacctcagttcatattcctcatacttgt

SEQ ID NO: 377509 - DNA, 465 bp, Homo sapiens
aaaaaaaaaaaaaaaaaaaaaggtttcaatagtgaaaaggactatatagatctgaagtgattataaaacaaggaactgataacaatgactttaatctgattataataagctctcggtgttagtccctgatattcttaggtaattttaaaaattacgtctcacaattcccattaggcacggtttctctttctgttgaagtgctgatattttattgtggggtaaagtggagattcagctgcataaagacctggaataggtataaatattcaaatttggcttcacagagaagacttgtgactagatttttctaaaatgaaaagacatgtttggcttatgacttaaaacagtcaaacatgtttggtcaaaataatacatatactaacatctgagtgctcagctgtagtcccagctactcgggagctaacgcaggagaattgcatgaaccctggaggggttccgcctcga

SEQ ID NO: 377510 - DNA, 480 bp, Homo sapiens
actaatgtttcttcatggttaaatttaggttaagtggaaagactactacatactactacctaaatgatcttgtgtcgtcctcagtgtgtcatatcaccttgaggcatgtgtcaggagacacatgatatccatttgtcccattattgttgaactttgatgactcaattaacgtggcccctgctaggttttgtctgtcaagttaccatttttccctttgtaataaataagttatctgtggagagatactttgagactgggtaatagtcctattcgctagccagctttcactcagtagttgtagtatctattgatttttgtcggattaatttatgataatgatggtgggaaaatgtggtatactaaccagtgttctagaacttaacacttgtatttggtagtctgtaatgttcctttttctccccatttgtgcttttatttatgtggtacaataaatatcaaaatgaaattataaatgtgtac

SEQ ID NO: 377511 - DNA, 340 bp, Homo sapiens
ctaaggatatagtaatttaaagacccttacaaagcaagctgtgtataccaggcattttttacccaatcttttttagttgtttcccctaaacctaattttctagtgttttagagacatgcctttgactctttacaaagcattcaacttttactgacccaatgacactctctgcatccacattttacttgtcgatagtaatatcgtattacctaattttgaaaataagtacaataacataaatcggttttgaattaaacagcttactggtaggagcagaagtgcaagtgtgcaccatggttaggcgtgccttataatatctgtcagtgctgagatggaaaac

SEQ ID NO: 377512 - DNA, 312 bp, Homo sapiens
cctagatttggggaactgtaacctctcttctttgatcgaatagttccctatgctttccttgtcataatagcactaatcattcctttactggaatgtttactttttgtttttgttttgtctttcctgataaaggcaggactggtatctgtgttgttctttactgtgtttgtaccaaccacagtggcttactatagataggattaaataaatacttgtgcaatgcagattaaattggtgcagattacttattgatgtttgctcacaagaggatttcaatgttcccctttggaatgtcccaccacaacctcccct

SEQ ID NO: 377513 - DNA, 808 bp, Homo sapiens
tctgttcattaaagagaggaggggaaaaaacttaatcaatatggctaaggggagagggaacttcttaacctatatggctaagggagggggaaagaaaccattctggaagcataaaaaaacaaaatgtagctttaaattaaaaccaaacatttattaccatgcagtgactaccctatgttgttaaaagacaaggattcgaattggcttttaaaaaaaattcagccactatatgatccaaaggtacatctttaaaaatatcataatggagaggttgaaaacacataccagacaacaaactaaaaaatttggggtgctactgttgaattagaggcaaaagtattatactgtgcaactttattattttttgctgttaaaaattcagtaaacactgtcaaagcaatcctcataaaactttcgtcctatcagaagacatttagaagtacaaggattggaagaaacacaactgctgctgcaatttggacttttttttcagagtaaatgaacattcgcacacaaaaaaagatatagaggagcgactgctcaaagcttaaactaataactacacactgtactttgtatgctacagaaagtaatttacaagatcaattaaatatttataagatttatactggccacaaagtgaattttaagggattttaaacattgaaattggccaagctctgtggctcacacctgtaatcccaacacttcaggaggccaaggcagcagatcacctgaggtcaggagttcaagaccagcccgaccaacatggtaaaaccctatctctactaaaaatacaaaaaattag

SEQ ID NO: 377514 - DNA, 263 bp, Homo sapiens
accctccactatggaaatgttcttgatttgaggttaaacagatgtgacaactaaatataatcctatctgtactgaagtggaaaatgctataaaggacattgagtcaactgataaaactgataaatacaaacagaggactacatgaaagtgttccatcagtgttaaatttactaatttcaataatggtatcatgattagttaagaaatacggcatatggctagttttaggaaatacacactggaagaatttaggagtaaaggac

SEQ ID NO: 377515 - DNA, 315 bp, Homo sapiens
tctactgagattttgtggcctcttgttacacagcagtaatgagggatacaagcgtacttacagtaaagtaattacactaaagcattgttgttattaaaaactcaaaataatactaatgtaaggcatttgtactgtggttgcatataaatggcagcaattgatatagtttttcctgggaggaaagtagaatacatatctttgtctacatttcagagactagaaaaaattatttggccagtatttgggagaccaccgctctttttggcttgaagtccattattttttccactataccaattactctggtaacagggc

SEQ ID NO: 377516 - DNA, 873 bp, Homo sapiens
gtcctgaagctatacagggaattgctgtctggtcatcatctattgttggaaaaaatcttctgtggattaactcagtggctcaacaggctgaagggaggtaggttggagggaaggaaatgggtgatagaattactttatgtttaaattctttgtattactcactgacattgtagccaaatcttaaaacagctttgtttgctttcagcattgaagcttgctataaatcacttcaccaggaggcatcttcagtttgttctttagttagcagcaatacttgagtgcctttcttatttaagaattagtggcaaatcacactgaaaaacaagacctgtcagttgttttataaatgcttttgaacttgatccctagttgagctccttccccctcagagtctgatacaaattaccctttattgtcagagtatttgctcattagtcctgtgaactctacattcagactcattgcttcctccagatagaggagcttgtaccataatattctgtgtccatttatgttagtttaatgaaatcttgcgaatttaggaaaataaaagaactgctcattcttccatatctttgtagtaacttctgttgtgtgtccttttgtagtcccatatttccatatccatatgctttgtaattcttttttctttcatgtcgttttctccattcttcaccaaaacagcagcatacataggcacatggttttatgatctgtttttcccactcaatatttaaaaaaaaaatttgccatgttaggtaggctgggttcggtgtcttacatctgtattcccagcactttgggaggccgaggcaggtggatcacctgaggtcaggagttgagactagcctaacatggtgaaaccccgtctct

SEQ ID NO: 377517 - DNA, 348 bp, Homo sapiens
catggcaagcactgctaatgctctcccccacacaacaagccctgggtatagtctgcctttggccagtgagaagcagctgaagcataacatgcaattcagtttaatttgaggccgaggtgggcggattacctgaggtcaggagttcgagaccagcctggccaacatggcaaaaccccgtctctactaaaaatacaaaaattagccgggcatggtggtgggtgcctgtaatcccagctacttgggaggctgaggcagggagaatgcttgaacccgggaggcagaggttgcagtgagcctagatggcaccactgcactccagcctgggcaacagagtgagactccatctca

SEQ ID NO: 377518 - DNA, 1174 bp, Homo sapiens
  misc_feature (239)..(239): n is a, c, g, or t
  misc_feature (779)..(779): n is a, c, g, or t
ggtaggttctgacagtttcatccatcacaatacaggcctcaccatgtcactgcctcagactgataaatgcaaaatgacagtcattcatccggtggaatagaagaagccagggaaaatacaacatgaagtcacttatgccatttgatatagctttgcaatgtgtatcttttctctcccctatcttttgttttgtttgtgtacatgccagcatgattatagtctttgcaaaaatatatacnagacaacacatttccctaaaataaaaaagtatgaatttagaaagattatagctacattaaaatgaattcagaatctactatgacataaatagaattagttaaagattaaggttagaaagtaaatgtcacttcttaactttttctctttcttgctattgaggagcacaatctaaaatttgtaggcagatagagtataaaagtaatgtacaattatggcacttatactatttttttcttttatacaacaattctacaaaaataatgactatatgtacacattaaaggaaactgtagatttactgaaaaataggtattaataatatggatatcaacagctgtgtacctttaatttaaaaattaaaaaaataaaaataacagtaaactgaaagtctccattctctcatcttccttttcctatgtttatttttaaacaaattatactgcatatatcgatatctattagggtcatgtgttgacttagcaataaatttaattattggtttagatatcttacagatgtatggaatctctaatatacanatttttgtttaatatgttactgagaaagaagctcaagtgatagaaataacacaggacaggaagtaagacagttctcgtctgaagttcttctctgacagcccacaaactagttaatatatgtgcctgtcacagtctccaccagaagctttatcttactacagagtccagatgcattaaggctgtgttcgagccatgatcttcctctgaagaagaaatgaagaagaaatttatcttatttttggatatagtgttcttagttggcagtttaattattatttttacttcatcactttgtatacgtcatcgcactttctcctggcctataagatctctcctgagaaattttacgttctactttactggaacttcattaaatattatttgcatcatttttc

SEQ ID NO: 377519 - DNA, 921 bp, Homo sapiens
ctttgaagaacaagctgccatgaatcctgcagctacaaggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaagggaaggatttgacagcttcttttgggcatatcagaatcgccagcatcactactcttgcactgtgcggccattattaagtgaaataaggattacttgaacacaagcactgcaatgccgctacagtcaatgtgataacccagctggtgactaagtgaccaaggacggggagtatctacagcggggagactctggaaaaagggaggattcacatccagtgccactggggcagggcagaatgagagttcatcatgctacaaagaatggcacagaatatacgacttgtgagtggattatctctggaattttctgttgactacatttgtactacagttgtatgtgggtaacaaactgtggaaagtgaaacttcgggtaagggggaggctaccgtagatagcccagtatttcttattttgtggatttgtttatctttctgctcacatccttttccttctgcattaccattttagtaaaaatagatagcatcca

SEQ ID NO: 377520 - DNA, 572 bp, Homo sapiens
ctttgaagaacaagctgccatgaatcctgcagctacaaggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaagggtatcctcctctcaccttcagtgcccggatgcaggaggtaactccctggtgaggaagacctaagtatatggccatagattcataaggagaatggaagagaaaagtgcttttaaaagtgataaatttgagaaaaact

SEQ ID NO: 377521 - DNA, 560 bp, Homo sapiens
ctttgaagaacaagctgccatgaatcctgcagctacaaggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaaggatatcagagagacttctctactgcttgggatgcttgttcagagtataatttccatagcagcaagaaaaggaatttttgtttgtggatactttaaagtaaataaagctattatagaaggcaaaag

SEQ ID NO: 377522 - DNA, 457 bp, Homo sapiens
aaatcattccccaacagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaaggaaggaagatgattccaagtcatgttatttccaaggaagcaacaataacttcactggacccctgctgatcttaaagtgcagcatgaaaaacagtcttggagacttctagagatgtccaaagtatgcctacggggagcaatagggataccaggagaatctgatggtagacgtatattaaaaaagctatttacatgttaaa

SEQ ID NO: 377523 - DNA, 634 bp, Homo sapiens
ctttgaagaacaagctgccatgaatcctgcagctacaaggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaaggaaggaagatgattccaagtcatgttatttccaaggaagcaacaataacttcactggacccctgctgatcttaaagtgcagcatgaaaaacagtcttggagacttctagagatgtccaaagtatgcctacggggagcaatagggataccaggagaatctgatggtagacgtatattaaaaaagctatttacatgttaaa

SEQ ID NO: 377524 - DNA, 953 bp, Homo sapiens
ctttgaagaacaagctgccatgaatcctgcagctacaaggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtgggacccatgaaggagcatcaagctcagcctcagatattcttcattattccatcatcatctcaaacctcttgggtatagtgtttgactactactgtgaccataaattccaataaaacctaggaaaaatgaaaccactacattaactgaaagggaaggatttgacagcttcttttgggcatatcagaatcgccagcatcactactcttgcactgtgcggccattattaagtgaaataaggattacttgaacacaagcactgcaatgccgctacagtcaatgtgataacccagctggtgactaagtgaccaaggacggggagtatctacagcggggagactctggaaaaagggaggattcacatccagtgccactggggcagggcagaatgagagttcatcatgctacaaagaatggcacagaatatacgacttgtgagtggattatctctggaattttctgttgactacatttgtactacagttgtatgtgggtaacaaactgtggaaagtgaaacttcgggtaagggggaggctaccgtagatagcccagtatttcttattttgtggatttgtttatctttctgctcacatccttttccttctgcattaccattttagtaaaaatagatagcatcca

SEQ ID NO: 377525 - DNA, 746 bp, Homo sapiens
ctttgaagaacaagctgccatgaatcctgcagctacaaggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtgggacccatgaaggagcatcaagctcagcctcagatattcttcattattccatcatcatctcaaacctcttgggtatagtgtttgactactactgtgaccataaattccaataaaacctaggaaaaatgaaaccactacattaactgaaaggatgtgcctgtcacagtctccaccagaagctttatcttactacagagtccagatgcattaaggctgtgttcgagccatgatcttcctctgaagaagaaatgaagaagaaatttatcttatttttggatatagtgttcttagttggcagtttaattattatttttacttcatcactttgtatacgtcatcgcactttctcctggcctataagatctctcctgagaaattttacgttctactttactggaacttcattaaatattatttgcatcatttttc

SEQ ID NO: 377526 - DNA, 488 bp, Homo sapiens
gaataaatatgatgtgttatgggatcacataagagacgcctttgggaggctgaggcgggtggatcacgaggtcaagagatcgagaccattctggccaacatggtgaaaacttatctctactaaaaatacaaaaattagctgggcgtggtggcaggtgcctgtagtcccagctactcaggaagctgaggcagaagaatcgctttaacccgggaggcagaggttgcagtgagccaagaccacaccactgcactgcatcctgggcaacggagcaagactccatctcaaacaaaaaagaaaaaaaagagagagagagatgcctaacccaaacaggatgggtcagggaatgcttcctggagaaaggggcacctgaacaagaagaacagaaggaactgagtatgcaaagagagatgatgtggtaccttcaggaaacttcagagactcagcatggccagagcataaaggcaacttgggaacaagaagaatgactc

SEQ ID NO: 377527 - DNA, 451 bp, Homo sapiens
cgatgtcaactataagcactccctgcagtctccaaccggggtcctagttctagtcttccggacagctctaggactcagttcatttaaagatcattggtgttggacacaactctcacccaataaacaactcagcaccagctcctcctggcttaggggagcagctcctctgcttccccacatgctctccagaagggtcaagagcgcccctcccagaagagttctaaatgtcccagctgatggcctcccatagacattccatgctggccacagttgcaggcctcagatgggcagccaagcccagtgctgacccatgagcttctccacctctctgcgtcaggagtcaggtgggggtgctgaacagaccctgtagcatggctcctctagcagtctggggccccagggacatcccttttagccccagtggattccctgggacagaggcaagggcggg

SEQ ID NO: 377528 - DNA, 845 bp, Homo sapiens
  misc_feature (666)..(666): n is a, c, g, or t
tgcttcctctctgaaagtctaacctagcatggcagtttctgccaggcatagtggggaaaagaataacaaattgggtgggtgttctctattgggaattagtcaggaagaatttgggggtttagatttttctttattttaaacttgaagtgagatatccctttcagataaatttgaatttaaaagataaatttcgaggcttctttttactccctttcaattttataattgaatattaaggaggaaattgtctgtagttgtcagccatttttctgtggtcataaactcttcagatactatcctctatacaatttttgccatctgctctgctagtgaccattacccaccccattactaaaaatcacacacataacattccattacataccctaaaacaagtgcaagactagcagaccccagactactcttgcttcttgttttaggtttgattttctttattttgttatggggtatgacactggtcaaggttgccgtgtagcatattgggtggctcggcaggatgacctaggggtctgaaattggcctgcgatctgcattgccagtttgacgtcccgaagttgccagtacgtctaagaactcagtccatcctcctatgcgtgtcccaatctcgtggagagagacggtaaggtcgtggactttgagggtggnggcctttctcctggggcgtttggaaaagacagtctaaggctgaagtcccagtctattcgtgaggtaataggccatttggaagtatgcccaggtgagggccatacactgaggctcgcggggaaagtgggctttggataccacggtggttcacgttggcttggacttccataaggtaacag

SEQ ID NO: 377529 - DNA, 210 bp, Homo sapiens
agacatccactttccagaaggtcagggaagaggaatcagctcgttaatagaatagtgatttaccatgttcaaagcttacacacaggccgggcgctgtggttcatgtctgtaataccggcactttgggaggccgaggtgggcggatcacctgaggtcaggagtttgagaccagcctggccaacatggtgaaaccctgtctctactaaaagt

SEQ ID NO: 377530 - DNA, 761 bp, Homo sapiens
cacagacccgcgccgtcgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagat

SEQ ID NO: 377531 - DNA, 767 bp, Homo sapiens
tttggaaacggagaaaatctaaaaatgaggatgtgaggaaagagtccgctctcaagggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagat

SEQ ID NO: 377532 - DNA, 196 bp, Homo sapiens
caaaagaatatctaactttcctttcttgctttgataaaaagcaaagcccaagaggtaaagtcaaggattaccaaccattccccccagccagcatcctggacttggggtttatccccagctttatggggttcctggccaggcaaaaggcaggcagggcttcctagctctctctatctttcctgttcctctcctaaag

SEQ ID NO: 377533 - DNA, 422 bp, Homo sapiens
ttcttttttgagacagggtcttgctctgctctgtcacccaggctggagtgcagtggtgcgattatacgattgtagttcactgtaacctcaaactcctgggttcaaaccatccttctgccaagcctctcaagtagctgggactactatactcaactatttaggttttttttttggagagacagagtctcatgatgtcgcccaggctggtcttaaactcctgggctcaagtgattctcttgccttggcctcccaaagtgctggaattacaggtgtaagccaccatgcccagcccctcgctgaatattttttatgtagtatcctttataatttctttgagggtattgataaattaacttcctctttgtttaatctgtttcgtgtttgttttgatctctgccttttgggttagaggctttccccta

SEQ ID NO: 377534 - DNA, 253 bp, Homo sapiens
cacttctgaccagctaatgttagaaaagggacatgctctgtgtacccaaggcaggcttttggtccccgtggtagctattgagctattcagagggacaggaaataaaactgctaattcaggccaggtgcagtggctcatacctgtaatcccagcaccttggggaggccgaggtgggaggattgcttgagctcaggagtttgagacagggcgataccctgtctctgtgagaaaaaacaaacaaaaaacaaaagaa

SEQ ID NO: 377535 - DNA, 1964 bp, Homo sapiens
  misc_feature (1791)..(1791): n is a, c, g, or t
agcgggtagcagcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggaatttgccatttgtaaaaaacagtctttctgttttggcttcttcgatttaatcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgttaaaaaaaaanaaacaccaccttatcccacaaccgaccatccaccaccacacaaacaacaaagagggggggggcaaacttccggggcaccaatccccacttttttgagccccccgtgatcaaataaaagccgcggcacaacaggcgaaacaccctcttcagaacctctgcgttatcaccccatt

SEQ ID NO: 377536 - DNA, 1222 bp, Homo sapiens
  misc_feature (1049)..(1049): n is a, c, g, or t
cgcctacacaattctccgatccgtcccctaacaaactaggaggcgtccttgccctattactatccatcctcatcctagcaataatcgccggtcacgagatatctcgtgaccggcgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgttaaaaaaaaanaaacaccaccttatcccacaaccgaccatccaccaccacacaaacaacaaagagggggggggcaaacttccggggcaccaatccccacttttttgagccccccgtgatcaaataaaagccgcggcacaacaggcgaaacaccctcttcagaacctctgcgttatcaccccatt

SEQ ID NO: 377537 - DNA, 1049 bp, Homo sapiens
  misc_feature (876)..(876): n is a, c, g, or t
ggacgcgtgggtcgacccacgcgtccgggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgttaaaaaaaaanaaacaccaccttatcccacaaccgaccatccaccaccacacaaacaacaaagagggggggggcaaacttccggggcaccaatccccacttttttgagccccccgtgatcaaataaaagccgcggcacaacaggcgaaacaccctcttcagaacctctgcgttatcaccccatt

SEQ ID NO: 377538 - DNA, 1043 bp, Homo sapiens
  misc_feature (12)..(12): n is a, c, g, or t
  misc_feature (870)..(870): n is a, c, g, or t
cccccgggctgntcgaattcggcacgcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgttaaaaaaaaanaaacaccaccttatcccacaaccgaccatccaccaccacacaaacaacaaagagggggggggcaaacttccggggcaccaatccccacttttttgagccccccgtgatcaaataaaagccgcggcacaacaggcgaaacaccctcttcagaacctctgcgttatcaccccatt

SEQ ID NO: 377539 - DNA, 752 bp, Homo sapiens
  misc_feature (579)..(579): n is a, c, g, or t
tatcagctcggtccctgttccccctaaaaatctatttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgttaaaaaaaaanaaacaccaccttatcccacaaccgaccatccaccaccacacaaacaacaaagagggggggggcaaacttccggggcaccaatccccacttttttgagccccccgtgatcaaataaaagccgcggcacaacaggcgaaacaccctcttcagaacctctgcgttatcaccccatt

SEQ ID NO: 377540 - DNA, 1911 bp, Homo sapiens
  misc_feature (1738)..(1738): n is a, c, g, or t
agcgggtagcagcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgttaaaaaaaaanaaacaccaccttatcccacaaccgaccatccaccaccacacaaacaacaaagagggggggggcaaacttccggggcaccaatccccacttttttgagccccccgtgatcaaataaaagccgcggcacaacaggcgaaacaccctcttcagaacctctgcgttatcaccccatt

SEQ ID NO: 377541 - DNA, 1926 bp, Homo sapiens
  misc_feature (363)..(363): n is a, c, g, or t
  misc_feature (385)..(385): n is a, c, g, or t
  misc_feature (429)..(429): n is a, c, g, or t
  misc_feature (447)..(447): n is a, c, g, or t
  misc_feature (455)..(455): n is a, c, g, or t
  misc_feature (463)..(463): n is a, c, g, or t
  misc_feature (505)..(505): n is a, c, g, or t
  misc_feature (508)..(508): n is a, c, g, or t
  misc_feature (528)..(528): n is a, c, g, or t
  misc_feature (548)..(548): n is a, c, g, or t
  misc_feature (1753)..(1753): n is a, c, g, or t
agcgggtagcagcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggaaanaaaagactttaaaacaaaaaanaaagcaaaaaacaaaaaaaaaatttataaaaaaaagaaaaaaanaaagaagaaaatgtgaantgaggaanaaaaaaanaaacaaaagaaagaacaaaaaaaaaaaaaaaaaaaaaaaaanagnacaggaaaaaacaaaaaaanaaaccattaagaaacaacanaaaaaacttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgttaaaaaaaaanaaacaccaccttatcccacaaccgaccatccaccaccacacaaacaacaaagagggggggggcaaacttccggggcaccaatccccacttttttgagccccccgtgatcaaataaaagccgcggcacaacaggcgaaacaccctcttcagaacctctgcgttatcaccccatt

SEQ ID NO: 377542 - DNA, 1558 bp, Homo sapiens
agcgggtagcagcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttggcccgagctataaatttgttgtttttgtactaagaagaataaattttgtctctctgtcgttcattttttcttagcgctttccattttggcgaacaacctttataaagcaacctttttctccgcccttatccccttacctttcttcgccctacaattctcctcctatccttaatttgggcgccttttaatgtatttaatatttcaaataatt

SEQ ID NO: 377543 - DNA, 1055 bp, Homo sapiens
  misc_feature (882)..(882): n is a, c, g, or t
gtctagaggatcccggaatcgggcgggcacaagaggagcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgttaaaaaaaaanaaacaccaccttatcccacaaccgaccatccaccaccacacaaacaacaaagagggggggggcaaacttccggggcaccaatccccacttttttgagccccccgtgatcaaataaaagccgcggcacaacaggcgaaacaccctcttcagaacctctgcgttatcaccccatt

SEQ ID NO: 377544 - DNA, 409 bp, Homo sapiens
cctctccttcccatctagcacgtatctgtgtgtgcaccctgtcatgccactgctgctggtatgaatacaccctgctccccacccccacaccaccacaccaccacaccacgacacagccattaccgttggagcaatggctgacatagagcccactgaccccacccccatcagcatcttgcctctgtgctatcactgctgccaccgtggaactaagcatggagaacagaggacccatccctgccttgaggagccaccactgcccccatgaacatgcacaggggacacacacagtcctgtgcccacaactgcctaacacctagcctaacaccaccaccaggatgaatgcatgcccccagtcttccccatgccatgctgcgaccaccactgatgcaaacgcccagatggaggc

SEQ ID NO: 377545 - DNA, 415 bp, Homo sapiens
tgccatcactcgttcagacggccgattggctgacggtcccgtcaatctccggggacatgactagcctcagacacctcagaaaattattttctgtgtgaggctgaaactgttggaggcttcctgagatcattcttgagaatggagcgaccacataggggtgagcagaaccaagagaatctcagggaaatggagccaatcaactgagttaggtcacccctaacttcaacccacacttgagtgttagagaagattctacaaagagagcagacttttctagtacctttcaattctcaccatgtaggtaaccatattctctagcaactgggatatatgtctttctcaaaagttccagttatctaacaccttcacaggtgtcacagctctccagaaaataaaatcaactctgtgtgtgtgt

SEQ ID NO: 377546 - DNA, 340 bp, Homo sapiens
ggaggaaaaagcacagtggtgcttcccaaactaatctgtaatagaaccctcttaagaacaccaggtacctgttccggaacagatgctgtgaaccccctaatgccctattttcaagtatactcctgtgaagtcttttttttggttgaactttatttagccaattgttgaaattggtcctttgctccatcctctcagtgggtttgtatcatgattccccaatccagtgtttcagctttcccctgagattcttactgtcagcaaatcagatcagcctatgacctatgttctcatacaatgcatagataagcgcttggaaaaggacaggagcaaggacagagcc

SEQ ID NO: 377547 - DNA, 438 bp, Homo sapiens
  misc_feature (234)..(234): n is a, c, g, or t
  misc_feature (290)..(290): n is a, c, g, or t
  misc_feature (350)..(350): n is a, c, g, or t
  misc_feature (392)..(392): n is a, c, g, or t
  misc_feature (400)..(400): n is a, c, g, or t
ttgagtttctaatatttgactggagaaataaaggcttttaaaaccatatgctgtaactttaacgtatttaaaaacacaacgttggctgggcagggtggctcacgcctgcagtctcagcactttgggaggcagaggagggcagatcacgaggtcaggagttcgagaccagcctggccaatacagtgaaaccccgtctctactaaaaatacaaaaattagctgggcgtggtggttnaggccctgggagggctgctggtggtctacccttggaacccagaggttcctttgaantcctttggggatctgtcaactcctgatgctgttatggggcaaccctaaaggtgaaggctnatggcaagaaagtgctcggtgcctttagtgatggcctggttnacctgganaacctcaagggaacctttgccaaatggattaagctgaa

SEQ ID NO: 377548 - DNA, 782 bp, Homo sapiens
ggagtcggtaccccacttttgcggggtgggggggaattgctttctgttttgttaatatctcagtttgggctaggggttcctggacaaatgggcttggttgtagagtactagtccattgtccctacagctcaagagatgcttctgtctgccagctcaggatagtcagagaaggcatcctgtagtcccctctacactagtgggcttttcttcttctttttttgatctacctatcttctggtaagtgtagcccttttggggatcatgactttatggaataggagggtatctcttctcacctcctaccttgagcagacccaaacttctcccccgtccctttgagggctgaaaactcaaatgtcacagacagacgttcacacttcatttggtctgaatattgctagccatggaatttctaaaatttgcttctacgaactatttattagtttcagtgtgctaagcctgctgggaggaaatgctggttgtgagcatcagcacagaagcattctggacggttattagcacaaagttagcatatgattttgtaatctcttctgctaacagtgttttttaaactaactctttacggtgtcctgtgtactaggtactgtgcctgtgctgacttcctagctttattggaagttccttgacagcggaccgaatccctacccgttactctttctccatctccctctgcagtgctgagccctcaaaaacaaaacagcaacaaaaaacacacttgcactagttgctgattggttaatccccacggaaaggttaccaac

SEQ ID NO: 377549 - DNA, 254 bp, Homo sapiens
aatattttttcccctaatgcttggagaatgataacaaaaaagaattttttattggttcatttcatgcttggtaagattccaactgtcaaaacattataaaattttgaacctagaggcacattacatcaccagagtactaattgctgcagagaactggagcgaggcattatgtagtagtatttattagagctgcccaattttaatgttttttggaccagagacacttaaataaaaggttaagctgtttgggcaca

SEQ ID NO: 377550 - DNA, 484 bp, Homo sapiens
gacctcatctctacaaaaaatttaaaaattagctgcgtgtggtggtgcgcacctgtggtcccagctactcagaaggctgaggtgagaagatcacttgagcctaggaggttcagctgcagtgagccttgttagcaccactgtactccagcctaggcaacagatcaagcacctgtctcaaaaaaagaaacaggtattaccaacaattttttaaaatacttttataactacattttaatgtaactagttttctttgtacagtagtcctatgtattttcctctggacttgatagcatgaggttgtagggcttgagctgcaacaaacatgtgaacacaaagggaccaaaaccacggaagctgagctcattaaataaaggaagagaaagattaagtctgatcacacaagtataactgaatcaagcctcaactttggactttttaatattgtgagccagtgaatttgagttggttttctgttacatctgca

SEQ ID NO: 377551 - DNA, 387 bp, Homo sapiens
tctttcatttcaacgttgaggtctagtgcacacagaacttgaaacaccgcactctgtcaacagcaataatccactcagtactgtgggatggatgggttaatggatgagaaaacggcaccaagactgactttgggtatttggtatatttaccgtggttacactctggactggttgattcttctgcatgtgatatagaaaaaagtgctgcatgcggtgaacctgtcagtctgggactgggggtgagttgttgttatgagtttggggtggtgtgaggaaagtgaatgctgcttagctcatctgtagctcattgcaatgaattcagtaagaatggagtacagggattatctgtgtagcataggcatgcaatgtttgaccaagctcttaccc

SEQ ID NO: 377552 - DNA, 195 bp, Homo sapiens
atattaaatatacaacttctatttggttttatctgagccattcctttatactgacagttacatgatgtgatttcagttatatatgtagttattggtaatttttcaaaaatagaatataatgaaaaaacttcatttcaatcattactgaactgcacctacattaatcacaatatacctatgaaaagatgtataaca

SEQ ID NO: 377553 - DNA, 776 bp, Homo sapiens
caacagttcagtttgtgttctggaagtggggaatggaaggagggaaagaggaggagcagggagagaaaagatgaggaacctggtaactgcaaaaaacaattcaagcagttatatttcaccatgtacagtctggaaagaagagttttctagaatcaaggaagaaaataaaagctctgttagtttgctcctgcatttgctatgcctttctaattaaatgattggaaggacttcattattgactcctgctggccgacatgacactaaaatgatatgcatctcaatctgcatactccaagccaaaacccaacatgccatatgcattgcacatgtccttccaaaggctttgggtctggatcctccttcccaccgtggccaacattgctttgtcctcatcaagaactggcagatccaaggagcatacccaagatgacgccacagcctacatgctctctcggcacctacatgctctctcggcacctacatgctctctcggcagcctacatgctctctcggcagcctacacgctctcttggcatgtacagcaggttcttcagccgtgcccaggaggcctggggctccgtggtctatctctgagctgggttctagacctcccaccccacttccaccactgcaacttctgttttacatgttggaaaggggcttcttataatatgccacttaaagaaaaagactgaatttttttaaaataaaaaatatactggcctatgtcattaaaatgaaatatatcccaataaagttgtaaagcaaaaaaaaaa

SEQ ID NO: 377554 - DNA, 113 bp, Homo sapiens
gagattatggtaagtgatataaagtcaagtttttgatcacacatgtatgatgttacattatttaaggtgatgctggttgctgtaacaaataatcctcaaaatcacagtggctt

SEQ ID NO: 377555 - DNA, 134 bp, Homo sapiens
gctactgagtcaaacactgtgcttatgggcaccgatgacagagccaggctgcttggacccaaatcccaattctcccaggcttggggcctttaggcaagttgttcaacttccttagacattcagttcctcatcta

SEQ ID NO: 377556 - DNA, 344 bp, Homo sapiens
gggaacaatcctagaaaacactgactgctttacatttattggaaaaccaggctttggtttttaccataatgtgaatgtctttggtcttactgtctttgtttctggagtgggtagccatgattttgtgagttgtggagatagaatcttatgaatggagaaaacaagatagcaggaacgtctggctaactaatggtaaaatgtgaccttccccctctgcagaagtccctttacgtggacgagtaatgcttgtgttagaaatatatacatatgtaactaacctgcacattgtgcacatgtacgctaaaacttaaagtataataataataaatttaaaaaaaaagaaa

SEQ ID NO: 377557 - DNA, 257 bp, Homo sapiens
gaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctcc

SEQ ID NO: 377558 - DNA, 393 bp, Homo sapiens
aagtgatgtgcattctgggccagtgaaacctagagcagattggcaggaaaccatctcagtgtcttaccaagctttaccttgttacctttatgtgtacaaaggaaattgtgcccttaaatgatcaagaaaaacaggtgtgtttcccctggataatgagattgtggtttattttcttatttttgcttatctatattttctgcaatgagcatgttttatttgtgaaactaaatatatataaaaatatatggccgggcgcggtggctcacgcctgtaatcccagcactttgggaggctgaggcgggcggatcacgaggtcaggagatcgagaccatcctggctaacacggtgaaaccccgtctctactaaaaatacaaaaaattagccgggcgtggt

SEQ ID NO: 377559 - DNA, 344 bp, Homo sapiens
agatttatacattagtactaacaaggaggtatcttcaagactaaagtataacatttctatctttaatgctctttactcaaatagggtaaaaatttcagtacaaaaaaagtaattgaaattgacatgacaaatactaaatagtagagcaatcctggactatttgaaattaattacacacagcaaaattagccgggcctggtggcgtgcgcctgtagtcccagctgctggggaggctgaggcaggagaatggcgtgaacccgggaggcggagcttgcagtgagccaagatcacgccactgcactccagcctgggcgacagagcaagattccatctcaaaaaaaaaa

SEQ ID NO: 377560 - DNA, 215 bp, Homo sapiens
ggaggcataaacaatatggcaaaatatttataattattgaaattaagtacttatttgaaattttcagtagagttcaaaaagaaaaaattggtaatgaaattgctgcagatgctgtctctgtgtaggaagaaaaaaatggtaaactttgctttgtggtcatcagtttgccgttgtttgggaccttttcatatcatagtttttacccttaaattaaa

SEQ ID NO: 377561 - DNA, 557 bp, Homo sapiens
ggagcctgcaaacaccagtggccacagcctcctggcggccctgccagcagacatggcctagaaacaccgaggaccagcagcgcggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377562 - DNA, 902 bp, Homo sapiens
  misc_feature (1)..(1): n is a, c, g, or t
  misc_feature (5)..(6): n is a, c, g, or t
ngatnngggcgaggagaggcacaccactattgttttaatttgcttttacctgattcctggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377563 - DNA, 788 bp, Homo sapiens
ctgtgctccagcgcacatcggaattgcctggagtctcccagggctccctctgggtcttctgaggggagaggctcctgtgtgctctggtgtggcgggcacagccaggctaagaagctgcatcctggcctcggagtgtggctgtcgatcaggaatcttcctcaacctggagcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377564 - DNA, 646 bp, Homo sapiens
gacccacgcgtccgcggacgcgtgggccttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377565 - DNA, 902 bp, Homo sapiens
aaatagctagtacgagcctggtgtggaatcggcagaggcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaaaaaaaaaaaaaaaaactcgggtttttttttttttttgatagttgtgtctgtttgttgtgtgttgtatatgaagacacccccatcaacaagcagaggggggcggacaccgcgacgaagaggcgccggcagccccctctttgacagaggcgccgaactacagagggggggggcgtctaaacccacagcatggttggtcggggcgcggcagcgcgggacacaccaagcgcgggggcgaagacccacgagtgggggagacggtcgggcccccaataggctgaggatgacgccgcgaagaccggcgggccaccacaggggtg

SEQ ID NO: 377566 - DNA, 1141 bp, Homo sapiens
  misc_feature (14)..(14): n is a, c, g, or t
  misc_feature (65)..(68): n is a, c, g, or t
  misc_feature (70)..(73): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (93)..(95): n is a, c, g, or t
  misc_feature (98)..(98): n is a, c, g, or t
  misc_feature (112)..(113): n is a, c, g, or t
  misc_feature (137)..(137): n is a, c, g, or t
cacccgtttttccnaaaaaaaaaaaaaaacccccccccccccccccccccccccccccccccccnnnngnnnntntttggcnttttgntaacnnnganacgttaaaaaaaannaggctgacccgtcggattcccggntgtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377567 - DNA, 1191 bp, Homo sapiens
  misc_feature (14)..(14): n is a, c, g, or t
  misc_feature (65)..(68): n is a, c, g, or t
  misc_feature (70)..(73): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (93)..(95): n is a, c, g, or t
  misc_feature (98)..(98): n is a, c, g, or t
  misc_feature (112)..(113): n is a, c, g, or t
  misc_feature (137)..(137): n is a, c, g, or t
  misc_feature (1151)..(1151): n is a, c, g, or t
  misc_feature (1154)..(1154): n is a, c, g, or t
  misc_feature (1156)..(1156): n is a, c, g, or t
  misc_feature (1165)..(1165): n is a, c, g, or t
  misc_feature (1174)..(1174): n is a, c, g, or t
cacccgtttttccnaaaaaaaaaaaaaaacccccccccccccccccccccccccccccccccccnnnngnnnntntttggcnttttgntaacnnnganacgttaaaaaaaannaggctgacccgtcggattcccggntgtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaaaaaaaaaaantcngncttgtttgncctagcggnggagctttggggcgctt

SEQ ID NO: 377568 - DNA, 878 bp, Homo sapiens
  misc_feature (25)..(25): n is a, c, g, or t
agcccaggtagttggctgtgcttcnccagtacatggggttgtccaggatgttgaaggggaacacggtcactctcgcccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377569 - DNA, 795 bp, Homo sapiens
taacggatgatagagtgcgagaaatccgctacgggcggcagagacccccgaaccgttgagtgtgcacagatgggacgcttttaccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377570 - DNA, 959 bp, Homo sapiens
  misc_feature (14)..(14): n is a, c, g, or t
  misc_feature (65)..(68): n is a, c, g, or t
  misc_feature (70)..(73): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (93)..(95): n is a, c, g, or t
  misc_feature (98)..(98): n is a, c, g, or t
  misc_feature (112)..(113): n is a, c, g, or t
  misc_feature (137)..(137): n is a, c, g, or t
cacccgtttttccnaaaaaaaaaaaaaaacccccccccccccccccccccccccccccccccccnnnngnnnntntttggcnttttgntaacnnnganacgttaaaaaaaannaggctgacccgtcggattcccggntgtccggttccgggggcgcgtggctgcagcggggcccgcgtggtgcctcctgaggcggcccccggatgaagagatctgggaacccgggagccgaggcagacttctgcgttatgacccggctgctgggctacgtggaccccctggatcccagctttgtggctgccgtcatcaccatcaccttcaatccgctctactggaatgtgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377571 - DNA, 879 bp, Homo sapiens
  misc_feature (14)..(14): n is a, c, g, or t
  misc_feature (65)..(68): n is a, c, g, or t
  misc_feature (70)..(73): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (93)..(95): n is a, c, g, or t
  misc_feature (98)..(98): n is a, c, g, or t
  misc_feature (112)..(113): n is a, c, g, or t
  misc_feature (137)..(137): n is a, c, g, or t
cacccgtttttccnaaaaaaaaaaaaaaacccccccccccccccccccccccccccccccccccnnnngnnnntntttggcnttttgntaacnnnganacgttaaaaaaaannaggctgacccgtcggattcccggntgtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377572 - DNA, 1109 bp, Homo sapiens
  misc_feature (14)..(14): n is a, c, g, or t
  misc_feature (65)..(68): n is a, c, g, or t
  misc_feature (70)..(73): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (93)..(95): n is a, c, g, or t
  misc_feature (98)..(98): n is a, c, g, or t
  misc_feature (112)..(113): n is a, c, g, or t
  misc_feature (137)..(137): n is a, c, g, or t
cacccgtttttccnaaaaaaaaaaaaaaacccccccccccccccccccccccccccccccccccnnnngnnnntntttggcnttttgntaacnnnganacgttaaaaaaaannaggctgacccgtcggattcccggntgtccggttccgggggcgcgtggctgcagcggggcccgcgtggtgcctcctgaggcggcccccggatgaagagatctgggaacccgggagccgaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatcagcccagcacctgcgggagctgtgggatcagaggcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377573 - DNA, 414 bp, Homo sapiens
atgataaatggatcaggaccgagaacatggggaccctggtcctggcacaaaagccagactcaggaaggggcagtgctgcctgggctcggtcggcccaagtggcccagcgtcggccggagggccagggtcacggcaggaagggccagcctgggcaggtgggccgtggccctgagagaccctggctccagccaggcctgacctgcctctgtcctttcaggcacgccagccccacgggcctgctcctgacggtgctggtggccctcacctacataatggctctcctatacgaagagtgagtaggggctgcggcgggtgggggcgtggctgcccgactggccctgtctctccctctagaacctttccttgtggccagggcaggctcaggacaggctgccgtcagccaggcccactcca

SEQ ID NO: 377574 - DNA, 1008 bp, Homo sapiens
ctgaccacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggccgtggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377575 - DNA, 674 bp, Homo sapiens
ccccacacccccacaccctttcccatgcatgcctcgcttcagtggctgtctagagcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377576 - DNA, 433 bp, Homo sapiens
ggtgtggcggggtcaggagctggtcaccagcaaagagcccctggcgatgctccatccggccttgggcctgctgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377577 - DNA, 505 bp, Homo sapiens
tcccgtgatcactccccggcgagtccgcgtcccaccacgccccctcttggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatcacgccagccccacggggcttgctcctgacggtagatctcagcggtgaaggggtcttcggataggagagccattatgtaggt

SEQ ID NO: 377578 - DNA, 1075 bp, Homo sapiens
  misc_feature (14)..(14): n is a, c, g, or t
  misc_feature (65)..(68): n is a, c, g, or t
  misc_feature (70)..(73): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (93)..(95): n is a, c, g, or t
  misc_feature (98)..(98): n is a, c, g, or t
  misc_feature (112)..(113): n is a, c, g, or t
  misc_feature (137)..(137): n is a, c, g, or t
cacccgtttttccnaaaaaaaaaaaaaaacccccccccccccccccccccccccccccccccccnnnngnnnntntttggcnttttgntaacnnnganacgttaaaaaaaannaggctgacccgtcggattcccggntgtccggttccgggggcgcgtggctgcagcggggcccgcgtggtgcctcctgaggcggcccccggatgaagagatctgggaacccgggagccgaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377579 - DNA, 1175 bp, Homo sapiens
  misc_feature (14)..(14): n is a, c, g, or t
  misc_feature (65)..(68): n is a, c, g, or t
  misc_feature (70)..(73): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (93)..(95): n is a, c, g, or t
  misc_feature (98)..(98): n is a, c, g, or t
  misc_feature (112)..(113): n is a, c, g, or t
  misc_feature (137)..(137): n is a, c, g, or t
cacccgtttttccnaaaaaaaaaaaaaaacccccccccccccccccccccccccccccccccccnnnngnnnntntttggcnttttgntaacnnnganacgttaaaaaaaannaggctgacccgtcggattcccggntgtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatcagcccagcacctgcgggagctgtgggatcagaggcacgccagccccacgggcctgctcctgacggtgctggtggccctcacctacataatggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaa

SEQ ID NO: 377580 - DNA, 439 bp, Homo sapiens
gtctgatttatctcagagcccagtgtttggtttgtaattttttcctaactgtgggatgtgatgcctgcacttagccatcaccatagcggttcaaagcgtcaggttttggggggttttttttgtttatttttgttttgaaacagagtctctgttgtccaggctcggagtgcagtggcaagatcttggctcactgcaacctctgcctcctggattcaagagattctcatgcctcagtctcccaagtagctgggactacaggcacacgccaccacgcttgggtaatttttgtatttttaatagagacagggtttcaccatgttggccagactggtctcaaactcctgacctcaaatgacctgcccacctctgccttccaaagtgctaggattacaggcgtgagccacggtggccagtctgtttcttgttggtggtggtggtt

SEQ ID NO: 377581 - DNA, 632 bp, Homo sapiens
atgccagttgattttagaggtgaacattctccctcaagaacagggttctacttaggcttgtcagactagtttataagaaactgaatttttgtccttcatatgtgtcccttttttatttcagggaagcattaagtggataggattccatgaagtgggatgagtaatactcaggctcatataattgttccaaagccagtatcatttgagattcactgtgtgtaatgagatattactgatgggggatgagttgtcactgtgagcagtatggagattgagaatctagctcattctaaatttaatttccttttaatcacaacagacattttttcttcttatgagttagtgtgttctttatgcttatacagtaaactgtcacatcctaggatacaacaagtgctacgaagtttgtttcaatgcacacaaactgtgaatcacttggtaagggataattaggttaaaaaaaggggaagggaactaggccttgggcgtagtaaagagctgcaaagcacattggtttagggggttgaaatgaaattctagagaaaggcacctgaccgttagtaaacctagaccttagaattgctgtcttgaatcagagaaatggtaggagctattatgagttgtgggagaca

SEQ ID NO: 377582 - DNA, 449 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtggtaaggactatttatcaaaaacattaaactttagtgagtaggttaggaaatt

SEQ ID NO: 377583 - DNA, 4971 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacgacagaggtgacagttctacactaacaaagcaagaacttaaattcataggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377584 - DNA, 5146 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtggctggagtggagtggcgcaatcattgctcactgcagccttgaagtcctgagctcaagagatcctcctgccgcagcttcctgagtagctgggacttacagagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377585 - DNA, 5099 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgttattgcttactgtgagctaagacagttttgcctaacctcgaagtcatgaagagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377586 - DNA, 4965 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377587 - DNA, 4992 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377588 - DNA, 4626 bp, Homo sapiens
ggatctaactgcgaaccaaaggttgcaccaacaaccgcttggaatgctgcaacaatggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377589 - DNA, 4032 bp, Homo sapiens
tttttattgtctgaaatggaaatgtttcaacagagccatcagcaagcaggaatgcagcagtgtctcctgtgacttttgtgattgatgtgttcagttctcagttctatgcaatgaaagtaacataacactgggcttttctgtgaatagcctaaacctttatttgcataattcatgaaattgtattacacaaacttggttaaaaaaatcctgttagagaatttctgcagtgtttagtaatcctgtgaatgttcaccagttgacgttttgtcgcatttgtctcttgtactgtcttaatgagccactggatttgctttgtttcattgcatccttaaggattgggttgacatgtccaagtagtcatgcctgtttgggggaagggaatggatttagcagttcaccaagaatggatcagtctgtctttaccgtttaagggtcagaggttacctgactcagaataaggggaggacaaccttgaaagaggccagataaggtgatttttataaggaactaactgcaggggaaatacaagttactttccaagcagagatatatgatattacctaaggaatattttgaaaaagttaatttttttcctttaaaattcaggattctgtattccctacttgtttttgtcaatttggaaatttagtgttttatgtaattttattcttggtgtaaggctctagtgtctaacaccataattttagtcttggtgtgcagctctatgtaaatgtgttttatggcttgtcttgggatgcaaagtgttaaaaaatacaaagcatacggatttgctgtgataagcatacagattagctgtccacagctgtgattcattactttaaccgtagaaattaaaagtggctgaggggagggtacagcaaatgcaaaccacgcttctgtgctgtaaaattgaaaggaatgaaagaacagaacataatccatggccttctacacccacaaaaacgtgtagggacaacgccttacatgccacagttcagcaattctgaactagcaacatgctagatcttctattttcgtgggaactgcaaagatagtggtaaaggtttaatgtatgttttaggaaaaatcagggcaagagtttaaaacctcttatctagtgagagtcactttatcagctctgaaatatttacactacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377590 - DNA, 2560 bp, Homo sapiens
ttgaatgtttgttcaaaactaggggactaaagctatgttgttattaagcatacttttgggggaataaatacttttaaatggatttgcagtgggtactagaaagctatttcctgtagctctcttccttggtgtttagttttaccattgggaccattagaaaaggataggtcaaatcagtggtatgtttggattctttgtttcaaatatgtgtttacttagtgtgagttaaattatccttgaataattaaagataaattattacatacgcttgttagaaacacatgtaaatttctattccataaaatgagttagggcctatttgttttataataaaaacatttcttgacaatgtgaattcttgtttagctgtacacatggatgtatataaacatacatatatatagaaattgtacataactgttttcagagtgtttggattcagaattgtacttaagttattaaacatcaaattgaaaagttgtctttcatttttagacttctaaaaatgcattagaggtgtgtagtaaaaagtaagaattgtaatcatttttcagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377591 - DNA, 1615 bp, Homo sapiens
ctatgaagaaacgcaacaagaaactccttgcagcaattaatcctttgttgtgcatgagtttcttgttgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377592 - DNA, 2797 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtgg

SEQ ID NO: 377593 - DNA, 2337 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcaggtaggggtttgcctattattatttttctccttcactcccaccacctcccttcttctgtcccaaaacgttttcaactgttgttacgataatacttgaaattaataaatgacatttaattaaagtgaaatttctcagtttttaaattttctaatggaaaatacaaaaatatcttaaagtcttagatgatttggtgtttgggaaagatgttcggcactaatttgattttacttaattaaatgtaggctaaacaatctattggtcattcattacttacaaaacacttagaatttatttcctatttttgtttcacctgcacagtattttttttttaatgcagaatttatatttagggtgtgagagtttttaccctttggtttttgttttgttttgagctccctttctctaaacttcaattttagtaatcattttctaaacgactcctcacacagatactacttgaattaccctatcctgagacatttttatatcagtgataaatgattttaatttatggaatccagcagtcacatttt

SEQ ID NO: 377594 - DNA, 967 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgatggtatgcaattcctgttggttagcctcatctgaaaacgtcactcctggatacatagaacatcactgcgcatgtgcatctccccacccccgatgcctggtgtctaacgttcctccagtttctggtgctctgatgcattgcttttgggcttgtcttactacagcagctttcttcggtcctcagtcatttaccacttgtcatatgtcctttctagtttccagggatattcttttttatatttatggctttatgccatttatctcagttgtcatttggcgtttcaagaaggagaggtggtagtgtttaagtggaattaactacttgtgtttctgatgtggtcttttatatttcttacagggttttgttttaccaagtactagtcttcagtctatcctgtttacttgattttttcccactcaactcacaaacatttttgaatcatctcatgaattctgctttccatttacatttttgcccttttgtcttttcctcttcgctgttaaacttcctgaaaaaataaaactagttgattcacttcttaaaa

SEQ ID NO: 377595 - DNA, 654 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgttattgcttactgtgagctaagacagttttgcctaacctcgaagtcatgaagcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatcctt

SEQ ID NO: 377596 - DNA, 545 bp, Homo sapiens
ttcatcataagtgatctagcggggttcttagcttagtaagagagaaatatatctgatcatgatcacctgtttggggttgacaaacctggttaccaatattcctttagccagatggatgttggaatttgaggatttagaattacacttttatgattcttgtttttcttcagctgctcctggtgtctctgagtgtagatttcttccatttaccctctctaggaaattaagctttgcagttttctagggcaggtgagagccagttacgcgttagtatgtagtgaataagggattgttttgattgcttttcagatggtatgcaattcctgttggttagcctcatctgaaaacgtcactcctggatacatagaacatcactgcgcatgtgcatctccccacccccgatgcctggtgtctaacgttcctccagtttctggtgctctgatgcattgcttttgggcttgtcttactacagcagctttcttcggtcctcagtcatttaccacttgtcatatgtcctttctagtttccagggatattctttttta

SEQ ID NO: 377597 - DNA, 837 bp, Homo sapiens
gaaatggtaggagctattatgagttgtgggagacagaacacatgatgaaatagtatgaaatcttatgggcagggttgtgattatgcctgtgtaggaaagaatttgactaatttaacacagcctttataataaggtagtataagacatgtacttataggtaagactttttccatttcaaagtatccaggctattttgttgctcttggttccttgaagataggcttcaaagactcttaagggataaacacatttggctggtgagtcccccactggggagaaaaagtagttttcacatttggctggtgagtccaccactggggagaaaaagtagtttccagtatccatgttaacttttataatggaaaatgaatctacactctttcattgaaactgcaagaggggtggaagctgaaaagttccaactgagtgagggaagcagtacaaatgggaatgagttgtgtaataattacttttaaattaactggtaatgccattactactctctttatttagagcactgcaattttttaaatttacataggtttcatggggattttaaccctgatgatccacccccacactgcaccccatcataatatcttcagtttttcaacttgtctgtcatggtggtttttaggaagtggtgattaaaaatctgaaattaaagtgtgtcttttctttagacagaggtgacagttctacactaacaaagcaagaacttaaattcataggtatgtaccaaactccagcatggttctaaacataatagtgttaaattaatcctattgtagcttggaaaccttcccatacaaaccagtgttagcagtatgtactcat

SEQ ID NO: 377598 - DNA, 1848 bp, Homo sapiens
gtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaagctggagtggtggcctgtttggattcaggcccaggggccgagacattcccttcttcactcttttcc

SEQ ID NO: 377599 - DNA, 666 bp, Homo sapiens
cctcaggatcaactcaagtaattggaaaaagtatttgaaaaatgaggtggggtggtttccaaattgacctgcccagcatggaaaaggttcatatttctaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggtattagtgatgttttagttaaaatacttgtgtttaagatggttaataatagttatgctttgtaaaataattggtttgtttttgaacttataactaatggatgttctagattattatatgattagttgctttagtaagattactttaaagatagtgtttcctattaaatttttttaatagggactttttctttccttttataatatgatttgtgcttccagagttgaattgtaattttaatgtttaactagatatggaataatgcttaaaattggggagaaaaataataaaagctggagctttgctttg

SEQ ID NO: 377600 - DNA, 5047 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377601 - DNA, 5014 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactagtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377602 - DNA, 5251 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgactctacttcatgaggctggaaccatgactgctggcagctcttgtttccagccccttttaccagaagaaggggctctctagaagaatcctggaaaggactctgattggcctgtcttggatcatgtgcccatcatctctgtggctggagtggggagggtactgtgaatggcaaccctcactagaactacatagttggagtcagggagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377603 - DNA, 4681 bp, Homo sapiens
ggatctaactgcgaaccaaaggttgcaccaacaaccgcttggaatgctgcaacaatgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377604 - DNA, 5044 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgttattgcttactgtgagctaagacagttttgcctaacctcgaagtcatgaaggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377605 - DNA, 4495 bp, Homo sapiens
gtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataaaaaaaaaaca

SEQ ID NO: 377606 - DNA, 1543 bp, Homo sapiens
gccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggtattagtgatgttttagttaaaatacttgtgtttaagatggttaataatagttatgctttgtaaaataattggtttgtttttgaacttataactaatggatgttctagattattatatgattagttgctttagtaagattactttaaagatagtgtttcctattaaatttttttaatagggactttttctttccttttataatatgatttgtgcttccagagttgaattgtaattttaatgtttaactagatatggaataatgcttaaaattggggagaaaaataataaaagctggagctttgctttg

SEQ ID NO: 377607 - DNA, 407 bp, Homo sapiens
ggaactggagaaacagcaaaccaaacccaaagtgctgggattacaggcgtgagccaccacgcccggctggaagacttaatttgtgggtgactaatcataatgcttaaatgaagaaaagacaataaaattcaatccctcctcttctttttgtcctcaggatcaaaatacttgctggatggtggactcagagaccaataaaaataaactgcttgaacatcctttgactggttagccaggtaattcagctttagtttgatttgatcctttgtaattttttgtcttcaaccttctgaagatattaccctcctctttaatttatgatttaattaaaactatttatgcttcatgtttttctctttaatgattattaaatgaatgtgcttagagtacttgagtatccgtatgtg

SEQ ID NO: 377608 - DNA, 1116 bp, Homo sapiens
atcttcagttgcttcagaccatctggatgtatatgtgcaggcttggtctcagaggcctgacagttataatcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaagggaatcgatctataatccaatctgatgtatgatgtggcaaaaagccgatgtggtctatctgatctgggctagggtcgtgattgataaaagactccttaggagccgtctttttgacttcagtgcatgtgttgatgtgtttccttatttgtgggtgagatcgagaccggaaacatttgtactttggtaatacaggacaaattgtccacacaataacgctgtctagtattaagcaatggaggaggctgtgttgatgaactacaagtgtattaggtaataatctttattgatttggatataggacacgaggatgattttcgtgggacatgtatcggcatcggatctggattagtttacatgtgtatctattccttgggaccaaaatggaggaccccaatgcggaacaacaaaaaagtccttggactcttttctgggtctggcccttttttgtctcatttctctggagacaccatctctgggaaactcgtccacacagggtcccttcggttccatacgacgacctcggcttacagacaataacctctcctcttcaaacttcttgggtcttgcgttttgcttctctggcctgccgtgatggcggcgtgcttcggctttcccttgtgtttcaacctggccttcgggggttctttcttcttcgagaaacctgtaggtgggcaatctttctttataaaaatcttaagtgaaaaacttactcggaaggggcgctggagccttcttaaatggtagggggacggggggcgatctaaataggtgagagagagctctcttccctagagaagaacctttcttaaggcgagcctctcttttctaacctggaagagtgtcgcggataaccttgagcttttctataaggggg

SEQ ID NO: 377609 - DNA, 8731 bp, Homo sapiens
  misc_feature (5)..(5): n is a, c, g, or t
cggcngcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaaaaaaaaaaaaaaaaaaaaaaaaaaaaaaaaaaaaagaaggagggaggcaaaaaacaaaaaaattggggaaggagaaaaaaaaaaaaaaatagggaaagggggcgaaaggcgttcaataaaaacaaacacggcgaccgggagccgggccgcctacaaacaaccgatcccggacggggcacatcaaccaagagtagccctgcgaaatcacatcgttgaaggacaaacacaccaccatacacggtgaagagcggcgataaccaaaatggggggcgtaccaaaacaccaacctgagacaatattatttaacgccctcccccaggaaagaacacatatcaatcagcaaacaacacagagatggtataggcgggtacgaaccacacatagcgcacagcatatctgtcgcacggcacgaggcaaacataatctgattggactcagagagcaagtagatactcacgttctaacgacaactatatcaccacgcagagttgagatgagggagtgagataaagagcgagggcggcgacacgaggcgcagagcgaccggcagccaggacaccagacgagggcgggggaaggaccagagcgacaagagcagggagatacgagcagggaggagagacgatcgcgacgagcggagacagaagcgacgaagagcagaagagaccgaaggagcggcggcgacgggctgcacgagagagcgaatcagggaggcgcgacgaaagcgaaacggacccaccgaacgcgccagacaacgcaccgcgagacacgaggaccggacgagagaacgaacagagagacgccacgagagta

SEQ ID NO: 377610 - DNA, 7892 bp, Homo sapiens
  misc_feature (5)..(5): n is a, c, g, or t
  misc_feature (7180)..(7180): n is a, c, g, or t
  misc_feature (7187)..(7187): n is a, c, g, or t
  misc_feature (7206)..(7207): n is a, c, g, or t
  misc_feature (7210)..(7211): n is a, c, g, or t
  misc_feature (7221)..(7221): n is a, c, g, or t
  misc_feature (7228)..(7230): n is a, c, g, or t
cggcngcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgggttttttanttccctnttttttttttctataaggnnccnnattgttttangggagannncatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377611 - DNA, 7902 bp, Homo sapiens
  misc_feature (5)..(5): n is a, c, g, or t
cggcngcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccattgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377612 - DNA, 7072 bp, Homo sapiens
  misc_feature (5)..(5): n is a, c, g, or t
cggcngcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377613 - DNA, 4817 bp, Homo sapiens
  misc_feature (31)..(31): n is a, c, g, or t
ttttggtgtgttggcttggggttgaaaaaanaaaattcggccgatctggtttattatttgtgtttgtagcatttgagttactgttcattaaaaatactatgcatggttgctgtgatctattactcttagaaaaaaaaaaagcaccattgacattgattgcaagtctttttctaggcctcgcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377614 - DNA, 4982 bp, Homo sapiens
tttcaagtattataattattacctccttcactgtttttgtgaggagtatcttctcccatccttccctaccctccccctggcccccatttctgctataccccaaatgcctagggtttggcaattacaatttggtgttgggattgggggtttaagctgtatatggtggtctaaagtggcctggtgaaatttctaaattgtgggccttaaacttaaattgatgccattcactcttttttaccactttggtttattatttgtgtttgtagcatttgagttactgttcattaaaaatactatgcatggttgctgtgatctattactcttagaaaaaaaaaaagcaccattgacattgattgcaagtctttttctaggcctcttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377615 - DNA, 2231 bp, Homo sapiens
agaggatcccgcctcgcgctcccaaagtactgggattacaggcgtgacgcgccacagcggccaaagttcctaagttctctatctctctgctgtgttttccctgctttaagtctgctgttacttttctactgagataaaatccactgtttgcatccaaccatttctttttgttattgtttccgcaaaccaatgagtttgtattaatatcgcatggctagagttctaaagtaaaagctataggattttggagtgtgtatgtgtgtgtttatgtgtatatacctgtattttgttatgtgtttttggccacaggtaccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377616 - DNA, 4206 bp, Homo sapiens
ggaactggagaaacagcaaaccaaacccaaagtgctgggattacaggcgtgagccaccacgcccggctggaagacttaatttgtgggtgactaatcataatgcttaaatgaagaaaagacaataaaattcaatccctcctcttctttttgtcctcaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttaaaa

SEQ ID NO: 377617 - DNA, 1431 bp, Homo sapiens
ggaactggagaaacagcaaaccaaacccaaagtgctgggattacaggcgtgagccaccacgcccggctggaagacttaatttgtgggtgactaatcataatgcttaaatgaagaaaagacaataaaattcaatccctcctcttctttttgtcctcaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcagacggagtcttgctctgttgcccaggctggagtgcaatggtgcgatctcggctcactgcaacctccacttcttgggttcaagtgattttcctgccatggcctcccaaacagtttggactacaggcacgtgccaccatgcccggctaatttttgtatttttagtagagatggggtttcaccatgttgtccaggctggtctcgaactcttgacctcaagtgagtcgcctgcctcagcctcccaaaatgctgggattacagttgtgagccactgtgcttggccgggagtaattcttgacgtcaacctgagtttcaatcttggtctgccattttttaatcatagaaataaaaaattaa

SEQ ID NO: 377618 - DNA, 314 bp, Homo sapiens
gtaaccagtcatgtgttcttccctctggcttctccttctgttgttttcagactatgtttctcagtgttcttaccactggtgcaatctatccctgtcaactaaagaaattctttttgttttacttctgtgtaaggttttatttgtacaaatggctccttgttaaggagtagttttatgagaatattctattttacaggtaaaaagtaaaaaaatgtcaggaaggattgctcttggggaagaaaaatgttacttgatgactttgtagtcttaaaggtagataaggttttttttgaaaaaaatccttactgctaata

SEQ ID NO: 377619 - DNA, 372 bp, Homo sapiens
ctttagagacagggccttgctatcttgcccaggctggactcgaactcctggatttaattgacccttctgcctcagcttctgagtagccaagactgcaggtgcacaccaccatacctggttttgtggttgattcttgatcttgtttgtcattatgtttggtatacacatgactgtagttgctctcttgttggtgaggggtaggaaaatgatgcctgagtgttcttattttaccctgttgatgattttggtgcagatccagtctttccttggatttttagaaatgtacttgaagtatatttcctccctgtcccctcctatatatatttgttttgctgactgtagttaccagtgatgggatattttccccaacag

SEQ ID NO: 377620 - DNA, 388 bp, Homo sapiens
tctaaggagaaggcatttgggcatttttatttcttctgttttatttttgtaaggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacaggtaaagaacagtgacttataaagttagtcacatcctagtcccagaagtccaagaacttaatgtatttttcagtcaagcctttttggatggagaggttgaaaggactgggttcatattagaaggtgtgatttggcttgtccattttgagagtccttcaagc

SEQ ID NO: 377621 - DNA, 601 bp, Homo sapiens
tttccccatgttaccaaagcaacccatgttgggtgggaatccaagaatgatggatagtcaggaaaattatggctcaagtatgggtacgttatttctaattagtatgtatgattattttgggaaaagcatatttaaaatacttaaagccatctaaataattgggagtaaataataactttttgaataacgttagtatgtttcttccatgaatatccttcatttattctatgttttggttatgtaaactcttcaagagtcttttggtctatgacattttccagcctgttgaatatatgagaatagtggcctatgtctccacagttggccagcccttttcttaccatgacaaagtgctgttttgtcaaggttgatgttgtgtataatggctgtacttacatggtataagaaggatttcattataatatggaaaagacctaagtatggctacctgttttaggtgggccaaaccgaaatgtgactgtgactcagactccttcctcaggagactggggcttaccaaactcaaaggccggcagaatggaacctatgaattcaaactccatgggaagaccaggaggagattataatacttctttaccca

SEQ ID NO: 377622 - DNA, 363 bp, Homo sapiens
gatgttattttgaatgtatccttagcatgtagagaagtgatgcctggcacataacaagcatttacttaaatacttgttgaatgactggatgttttttgcactttctttagagcatttgacttctgttgctttcatagatgttcttcactgttcttttatgtgttgtgtttaagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaatt

SEQ ID NO: 377623 - DNA, 233 bp, Homo sapiens
tgaaaaaagaaagttagatgtttcaggataatttttgctcttatttgagaatttgtgctttctttttgctcccccagggcctggtgaaatccccatgggaatgggggctaatccctatggccaagcagcagcatctaaccaactgggttcctggcccgatggcatgttgtccatggaacaagtttctcatggcactcaaaataggtggggtgttattttgtgactctgtagaa

SEQ ID NO: 377624 - DNA, 7918 bp, Homo sapiens
  misc_feature (5)..(5): n is a, c, g, or t
cggcngcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377625 - DNA, 7914 bp, Homo sapiens
  misc_feature (5)..(5): n is a, c, g, or t
  misc_feature (7202)..(7202): n is a, c, g, or t
  misc_feature (7209)..(7209): n is a, c, g, or t
  misc_feature (7228)..(7229): n is a, c, g, or t
  misc_feature (7232)..(7233): n is a, c, g, or t
  misc_feature (7243)..(7243): n is a, c, g, or t
  misc_feature (7250)..(7252): n is a, c, g, or t
cggcngcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgggttttttanttccctnttttttttttctataaggnnccnnattgttttangggagannncatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377626 - DNA, 7903 bp, Homo sapiens
  misc_feature (5)..(5): n is a, c, g, or t
cggcngcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagttaccagtgatgggatattttccccaacagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377627 - DNA, 5118 bp, Homo sapiens
  misc_feature (1)..(3): n is a, c, g, or t
  misc_feature (6)..(6): n is a, c, g, or t
  misc_feature (14)..(16): n is a, c, g, or t
  misc_feature (18)..(23): n is a, c, g, or t
  misc_feature (25)..(34): n is a, c, g, or t
  misc_feature (37)..(44): n is a, c, g, or t
  misc_feature (46)..(49): n is a, c, g, or t
  misc_feature (51)..(52): n is a, c, g, or t
  misc_feature (56)..(59): n is a, c, g, or t
  misc_feature (61)..(64): n is a, c, g, or t
  misc_feature (67)..(67): n is a, c, g, or t
  misc_feature (69)..(69): n is a, c, g, or t
  misc_feature (72)..(74): n is a, c, g, or t
  misc_feature (77)..(77): n is a, c, g, or t
  misc_feature (80)..(80): n is a, c, g, or t
  misc_feature (84)..(84): n is a, c, g, or t
  misc_feature (86)..(86): n is a, c, g, or t
  misc_feature (97)..(98): n is a, c, g, or t
  misc_feature (102)..(102): n is a, c, g, or t
  misc_feature (105)..(105): n is a, c, g, or t
  misc_feature (119)..(119): n is a, c, g, or t
  misc_feature (145)..(145): n is a, c, g, or t
  misc_feature (149)..(149): n is a, c, g, or t
  misc_feature (156)..(156): n is a, c, g, or t
  misc_feature (171)..(171): n is a, c, g, or t
  misc_feature (176)..(176): n is a, c, g, or t
  misc_feature (180)..(180): n is a, c, g, or t
  misc_feature (214)..(214): n is a, c, g, or t
  misc_feature (218)..(218): n is a, c, g, or t
  misc_feature (226)..(226): n is a, c, g, or t
  misc_feature (233)..(233): n is a, c, g, or t
  misc_feature (236)..(236): n is a, c, g, or t
  misc_feature (242)..(243): n is a, c, g, or t
  misc_feature (245)..(245): n is a, c, g, or t
  misc_feature (249)..(249): n is a, c, g, or t
  misc_feature (275)..(275): n is a, c, g, or t
  misc_feature (287)..(287): n is a, c, g, or t
  misc_feature (297)..(298): n is a, c, g, or t
nnnttncttttttnnntnnnnnncnnnnnnnnnnctnnnnnnnngnnnngnngcannnncnnnntcncngcnnnctncancctncncctcccaggtnnaagngantctcctgcctcagnctcccgagtagctgggattacaggcntgcnccaccanatctggctatttttntattnttantattttagtagagatggggtttcaccatgttggncagnctggtctngaactcntgncctcanntnatcngcccacctcggcctcccaaagtgctnggattacaggcntgagccaccnngcccagatgacaagactaattttttatccctttggtttattggctacaacatcttcttggaatcagaggtgaattttttcttaccttgggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377628 - DNA, 5014 bp, Homo sapiens
tttcaagtattataattattacctccttcactgtttttgtgaggagtatcttctcccatccttccctaccctccccctggcccccatttctgctataccccaaatgcctagggtttggcaattacaatttggtgttgggattgggggtttaagctgtatatggtggtctaaagtggcctggtgaaatttctaaattgtgggccttaaacttaaattgatgccattcactcttttttaccactttggtttattatttgtgtttgtagcatttgagttactgttcattaaaaatactatgcatggttgctgtgatctattactcttagaaaaaaaaaaagcaccattgacattgattgcaagtctttttctaggcctcgcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377629 - DNA, 7142 bp, Homo sapiens
ggaactggagaaacagcaaaccaaacccaaagtgctgggattacaggcgtgagccaccacgcccggctggaagacttaatttgtgggtgactaatcataatgcttaaatgaagaaaagacaataaaattcaatccctcctcttctttttgtcctcaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtatagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaa

SEQ ID NO: 377630 - DNA, 599 bp, Homo sapiens
ccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgcactttgggaggccaaggtcggcagatcacttgaggtcaggagttcgagaccagcctggccagcatggcgaaaccccgtctctact

SEQ ID NO: 377631 - DNA, 796 bp, Homo sapiens
ttcacgcccacagactaatgcctggtacgtaatagttgcttgttaaatgtttgtaggatgaccgaatgggccaaatgaaagattgttcgaacatcagctaagtggtcctgcttggacagcagccaccctctgttgaccttggccctggcaagctgggaggaaggctgctggaatcccaggggctctatggggcctgggcctcttcatccatttcccttggcttcctttgcagggtccgcctggcatgaggggctccccgggtcctccaggccctatcgtaagtatcagtggtgccctggtctgcttgagaagctctcaaaggggtcattacactcagacaccatcccgcggccttgtccccaaaaggctgggcaaggcaggaggagggaacttccactgccctccccatccctccgcagagcatctgcagggactgtgctctcccaccaccggatgccctggaaccgccctgctctgcctactgcctgcggtcctgcttaggggaggtcctcagaggcacctctttgcttccctgtccccaccctctgctgcgctttccacagtggccccaggccgccctcggcagggggcctaggcttcaggctcacagcctcccaaccagggaagcatgcggcatgctggccagacctctccatgcccctgtgactccagtccccacaagggctcggggctaagatggagctgtcctccattgctctgtagggccatctctagggtaaatctacaaaaaccagaccagggtatctactctggagtcctgtgtggcgtgacatgg

SEQ ID NO: 377632 - DNA, 1071 bp, Homo sapiens
ctcacaatagaccagtcacacttacactagggattggcaagttttccagaagacatgagacatagcgctgtgggatgagagggaggagcacccaacccagcctggggagtcggagaggctgcagagagaacaggaacacttcagctcaggaggggtgcactggatagagagagatgaggggaagggcattcaggaccataacaacatggcagaatcagagaatcatcaccagtgaggtctggtgggaggcagagggtggggagaggaggctgaggaaggaacgatcaggaccacataatgaatggccttgcatgcccggccaacgaatgagtgctttatcctgaggacatttgggagccatcagaatttctaagcagggagtaacaccaggagaactgtcttctagaaggaccactctggggcagtgaggtggagtgacctgtcaggatgctgtggccacagtctagagggagacgctgggggcctggtgggagggtggagagaaaagagcagattggtgagacatcatgatgtaaatttgacagcactaagtatctatctttgtagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatggtaagggggaaggctggcagctgtgggcactgtcccatagagcaggcatgtggggtggagctcggatcatcttccaagctcctgctgacattctgtgggaaagagcctggctcccatagagggcagctcttaactgtgtgcggaagggtggggatgataggaccctctccccagaaaaatgcacttaagaacaaaatgttttgtatcatatctgggtggttaggactttggattgagaatctacggaggttgctgtgagccaagatcgcgccactgcactccagtctgggtgacaaagtgagactctgtctcaga

SEQ ID NO: 377633 - DNA, 369 bp, Homo sapiens
aacggaggagccattcttcctggagccaaggggaggaacagttgtcttttgagccaagactttcaaggagtctcttttccagctgccttgaaaatactcccatgacctcctctccccatgacccccaagccccagactgtgccctccaggctgtcccagggttactgtgcctgtgagatgtgacctgcctgtttctcccaccagggccccccaggttttcctggtgctgttggctcccccggattgcctgtaagaacctagcgctgctcgacctcccctcccccccgtcagccaggtctctgtggcttttgcttgtctccctcctgtcgtgccttcacctccgtcctccgtgtttgttgtcccccttca

SEQ ID NO: 377634 - DNA, 5421 bp, Homo sapiens
ccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgacgagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccgcttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377635 - DNA, 5723 bp, Homo sapiens
ccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgacgagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccgcttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaaggtgagtgggcactggctgggcttgagaggagaagctcacgagtggatgaagcccagctgcaagttacggctttagccacagagaggagacacaggaaggccagtgggcagggggcaaaaatgcagaacttggagcaggatagtgtctgaaaatttctcacatggggtcattagctgtggttggggggaaggaaatctccagttcatttactcactgattgactgattgattcattcattgtttccatttcccgagcactcccttgctcctgctcacattccaggcccttgtcctggcctcagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377636 - DNA, 3543 bp, Homo sapiens
aactcagggctgggctagagtgccacctccggtctccatggcaacctcccagggctttccaggagactctagggtgccttttgggcaagctgggctggagcccacccttactggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377637 - DNA, 3666 bp, Homo sapiens
aactcagggctgggctagagtgccacctccggtctccatggcaacctcccagggctttccaggagactctagggtgccttttgggcaagctgggctggagcccacccttactggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377638 - DNA, 2211 bp, Homo sapiens
ttaatggcatggcacctgcaaaggctggggtaaggaattaggggtgggggctgtagctctcgtggaaagtgacatgccctctcaccctacaaagtgacagggactgctctggaggcagccttcctgtgtctctcccctgcctccctccaagaaagtgatttttgcttggggtgggggacttggacagggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377639 - DNA, 2199 bp, Homo sapiens
gggagccgcataaggtgtttgagcaagagagtgacataatcagagctatgctggaggagaagagggcagccatttgctggctggcttgcagtgagccaggaggtggcaggacgagttaggaggctggttcagtagctcgggcaagagcagggaagcctgagcagatcaggcagagggggcagtcccctgtcacatccccctacctcatccttcacctccccaggaggagtgactgattctgttcctttgtatccttagggccccccaggatctgaaggcctcccaggccccccaggcccagcgggtcccagaggagagcgaggaccccaaggtaactccggtgagaagggcgaccagggatttcaaggccagccaggctttccgggcccaccggtgagtgaagaagacacaaagccagctctgtctgatgtggtctcatcgggaggggcaggcctgaccaggccaggctgggggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377640 - DNA, 1856 bp, Homo sapiens
ttttttttttttaaaccctgtacctggtcaaaaagaaacaacaacaacaacaataataatgataataataaattccaaacaaacatctcctgggtaccaggtctttccaggccccccagtatgccacagactggccctctcattctgacttctcgcctctcttcatctgtgatgggggcgcagccaacatgcttaaacaaggccatgccccagaggacattattttcccttccagctgggcagggaggctgcgctcctttctcacacagagccgggctggacacacctgggggcctcaggctgtggaaggggcctcttcactgcacctgcctccccagggagcctcagagatgctgcccggacttcacctctgacttttgctttcctctagggaccccctggaaagcagggattctatggacctcctggtcccaaggtgagtgggcactggctgggcttgagaggagaagctcacgagtggatgaagcccagctgcaagttacggctttagccacagagaggagacacaggaaggccagtgggcagggggcaaaaatgcagaacttggagcaggatagtgtctgaaaatttctcacatggggtcattagctgtggttggggggaaggaaatctccagttcatttactcactgattgactgattgattcattcattgtttccatttcccgagcactcccttgctcctgctcacattccaggcccttgtcctggcctcagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377641 - DNA, 4628 bp, Homo sapiens
ccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgacgagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccgcttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctgtaagaacctagcgctgctcgacctcccctcccccccgtcagccagggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggacccctggaaaggcagggatctatggactcctggtccaaggtgatccaggagctgctggcacgaatggccaggccggaagaaggcgaaagcggaatgcttggtggacctggcaaaactggtccatgtggctgttggtcaccgggcctgccggagaaaacgcacctggactacgggctcgggaacccgtgttcctgcggtgcctggctctggagccctggaactcgagcaaacacaaggcagcgaaagcacatcactgtcgacacgcatcaccacgcgagcggcacagcatgggccgaagcacggcctgaagggccgagcagcatcacgctactccaaaccgagacagagaacagtagagacgacaacaccgaaatgatcacaagctatacagca

SEQ ID NO: 377642 - DNA, 3871 bp, Homo sapiens
ccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgacgagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccgcttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcgtaagtatcagtggtgccctggtctgcttgagaagctctcaaaggggtcattacactcagacaccatcccgcggccttgtccccaaaaggctgggcaaggcaggaggagggaacttccactgccctccccatccctccgcagagcatctgcagggactgtgctctcccaccaccggatgccctggaaccgccctgctctgcctactgcctgcggtcctgcttaggggaggtcctcagaggcacctctttgcttccctgtccccaccctctgctgcgctttccacagtggccccaggccgccctcggcagggggcctaggcttcaggctcacagcctcccaaccagggaagcatgcggcatgctggccagacctctccatgcccctgtgactccagtccccacaagggctcggggctaagatggagctgtcctccattgctctgtagggccatctctagggtaaatctacaaaaaccagaccagggtatctactctggagtcctgtgtggcgtgacatgg

SEQ ID NO: 377643 - DNA, 150 bp, Homo sapiens
cctccaagaaagtgatttttgcttggggtgggggacttggacaggtaagtgttgggtatctgatgatatgatacactttggtggcagcatccatctggggtacctctcctgacagttgcccctcagaataagcacacatctgatccatca

SEQ ID NO: 377644 - DNA, 231 bp, Homo sapiens
cctttgccttcctccccatcctttatttccataggggaaaatgccaggcttggaagtataattgaggcaggttttcttctctttcttcagggagacatggtgaattatgatgaaatcaagaggttcatcagacaagagatcattaaaatgtttgatggtaactggcagccagctgggtggcagtgggtgctgtctgcccttccttgtgacttctctgccctgccttggcct

SEQ ID NO: 377645 - DNA, 5466 bp, Homo sapiens
ccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgacgagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccgcttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377646 - DNA, 1245 bp, Homo sapiens
ctctccctcctctcctgcgttctttctctcctcttctctctcttaccccgttctgtcttccttctccatttctcgcaccatcttgcagcactcccccaagtcctcctgagctcgtgaaccttcctcttaagctggtgcctctagggggcccctccattcctgccttctcgctctgcctcctgcttctcaccaccttcggcgttgcctgaagatttgctgaaagtagttcttggggccctgccaggcacctggctcagagcccagcagagatgccaaagctttagggcttcacattgcaggctggcacaggtttgctgccctgctgcttggcagggctgtccagaggcacccagggatttaaaggcagcccttcctgcgccttttccgtcgtcctagaggaaactctcagctgcctcctcttcgcttcctcttccttggctccagtcccagtctgctccaaggcggggcatgtgatatcagccagttgggtttctgggtgtcgtgcggccctgcccctctgtgcccggcaccttggccggctccttctgccaggtgtcgttaattgctctgccttcgtcatcgtcacagggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagaggtgagggccagggatccacatggctgc

SEQ ID NO: 377647 - DNA, 3694 bp, Homo sapiens
aactcagggctgggctagagtgccacctccggtctccatggcaacctcccagggctttccaggagactctagggtgccttttgggcaagctgggctggagcccacccttactgagcacctgggagctgtcagacaaaaagggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377648 - DNA, 2612 bp, Homo sapiens
ctctccctcctctcctgcgttctttctctcctcttctctctcttaccccgttctgtcttccttctccatttctcgcaccatcttgcagcactcccccaagtcctcctgagctcgtgaaccttcctcttaagctggtgcctctagggggcccctccattcctgccttctcgctctgcctcctgcttctcaccaccttcggcgttgcctgaagatttgctgaaagtagttcttggggccctgccaggcacctggctcagagcccagcagagatgccaaagctttagggcttcacattgcaggctggcacaggtttgctgccctgctgcttggcagggctgtccagaggcacccagggatttaaaggcagcccttcctgcgccttttccgtcgtcctagaggaaactctcagctgcctcctcttcgcttcctcttccttggctccagtcccagtctgctccaaggcggggcatgtgatatcagccagttgggtttctgggtgtcgtgcggccctgcccctctgtgcccggcaccttggccggctccttctgccaggtgtcgttaattgctctgccttcgtcatcgtcacagggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377649 - DNA, 2692 bp, Homo sapiens
gagaagctggcgttcggagccagcctttccagcctcactcctcgtggcttgtcctcgcagtgggtgcaggttgcaggaacagccgggacagatggtccctctgcgggcccctcgcctccacccacatgcctgtctggaaagtggctttggcttagctgtaccagagcttcttcctggaggaaactcaaagccaattgttgggaagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctgtaagaacctagcgctgctcgacctcccctcccccccgtcagccagggccttcaaggagagcgaggtctcacgggcctgactggagacaagggggagccgggtcctccagggcaaccaggttacccaggtgccacgggccccccaggactgcctggcatcaccggcgaacgtaggtaacaccgggtcagcgggcacagaacgggacaggcccggccccccaggatctgaaggcctcccaggccccccaggcccagcgggtcccagaggagagcgaggaccccaaggtaactccggtgagaagggcgaccagggatttcaaggccagccaggctttccgggcccaccggtgagtgaagaagacacaaagccagctctgtctgatgtggtctcatcgggaggggcaggcctgaccaggccaggctgggggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377650 - DNA, 2166 bp, Homo sapiens
gggagccgcataaggtgtttgagcaagagagtgacataatcagagctatgctggaggagaagagggcagccatttgctggctggcttgcagtgagccaggaggtggcaggacgagttaggaggctggttcagtagctcgggcaagagcagggaagcctgagcagatcaggcagagggggcctgccagcccaggggcctcccagcacatgccacctctgttctgggcagtcccctgtcacatccccctacctcatccttcacctccccaggaggagtgactgattctgttcctttgtatccttagggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377651 - DNA, 1685 bp, Homo sapiens
ctcacaatagaccagtcacacttacactagggattggcaagttttccagaagacatgagacatagcgctgtgggatgagagggaggagcacccaacccagcctggggagtcggagaggctgcagagagaacaggaacacttcagctcaggaggggtgcactggatagagagagatgaggggaagggcattcaggaccataacaacatggcagaatcagagaatcatcaccagtgaggtctggtgggaggcagagggtggggagaggaggctgaggaaggaacgatcaggaccacataatgaatggccttgcatgcccggccaacgaatgagtgctttatcctgaggacatttgggagccatcagaatttctaagcagggagtaacaccaggagaactgtcttctagaaggaccactctggggcagtgaggtggagtgacctgtcaggatgctgtggccacagtctagagggagacgctgggggcctggtgggagggtggagagaaaagagcagattggtgagacatcatgatgtaaatttgacagcactaagtatctatctttgtagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377652 - DNA, 5349 bp, Homo sapiens
ccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgacgagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccgcttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377653 - DNA, 3833 bp, Homo sapiens
ccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgacgagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccgcttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccagtgagtacagtgccttggggcagcaggaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggcagccaggctttccgggccacgggtcccatggatacccaggcaacagtggatcacctggccacctggctcagcagagagggcaggaagggatcgaagccatcaggctgcgtggtccctggggcacggactctggatagaggcccgcggcgaggtggttggaagt

SEQ ID NO: 377654 - DNA, 641 bp, Homo sapiens
tctgattttccctctgtggcccttccctccctaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 377655 - DNA, 1442 bp, Homo sapiens
  misc_feature (1121)..(1121): n is a, c, g, or t
cctgctgaccagttctagtgaggccttgtccacgttccaaggacccctccgtgtcagtgaaccgataaagggagtgatcgggctctgcatgcgggggtgctgcgtgtgggggtcccagtcgaccgagaaccccacagacttgtcgcgccctcggcgtgctgccatttaatctcttcttgttttctttccacacaggattccgttggtgaacctgtaaaaacaaaacaaacaaaacaaaacaaaaaagacaaaacctaaaactgagctatctaagggggagggtccccgcacctaccacttctgtttgccggtgggaaactcacagagcaggacgctctaggccaaatctatttttgtaaaaatgctcatgcctatgggtgactgccttctcccagagttttctttggagaacagaaagaagaaaggaaagaaaggaaccagaggcagagagacgaggatacccagcgaaagggacgggaggaagcatccgaaacctaggattcgtcctacgattctgaacctgtgccaataataccattatgtgccatgtactgacccgaaaggctcggccgcagagccggggcccagcgaatcacgcagagaaatcttacagaaaacaggggtgggaatctcttccgatagagtcgctatttctggttaatatacatatataaatatataaatacaaacacacacacacactttttttgtactgtagcaatttttgaagatcttaaatgttcctttttaaaaaaaagaattgtgttataggttacaaaatctgatttatttaacatgcttagtatgagcagaataaaccagtgttttctactttggcaactcacgtcacacacatattacacacatgtgcgcatacacacacacaatacacatacatgcatatagacgcatctattggaaatgcagttccacaggtgagcatgttctttctggtgacctggtattccatcaccattcaccccaggggacagcctcgaccgagacaaggaggcccttaaatgacagcctgcatttgctagacggttggtgagtggcatcaaatgtgtgacttactatcttgggccagaactaagaatgccaaggttttatatatgtgtgtntatatatatatatatatatatatatatatatatatatatgtttgtgtgtgtatatatatatatatatatatatgtttgtgtgtgtatatatatgtttgtgtatatatatacacatatgcatacatatgattttttttttttcatttaagtgttggaagatgctacctaacagccacgttcacatttacgtagctggttgcttacaaacgggcctgagcccctggttgggtgggtggtggattcttggacgtgtgtgtcatacaagcatagactggattaaagaagttttccagttccaaaaattaaaggaatatatcctta

SEQ ID NO: 377656 - DNA, 2545 bp, Homo sapiens
  misc_feature (2224)..(2224): n is a, c, g, or t
tttccctgagtacgatccagaggaggccagaactccatgtccatccgctggccgggccgccccctcggaagccatgcctggatactgatagccatgtttcagctcgccgtggacctgcccgcctgtgaggccctgggcccggggccggagttctggctcctgccgcggtcgccgccccggccgccccggctgtggagttttaggagtggacagccagcgcgggtcccggccccggtgtggagcccccggccgccccgagtggagcggatccacgggcagatgcagatgcctcgagccagacgggcccacaggccccgggaccaggcggccgccctcgtgcccaaggcaggactggccaagcccccagctgctgccaaatccagcccttccctcgcctcttcgtcctcgtcctcgtcctccgcggtggccggtggggccccggagcagcaggccctcctgaggaggggcaagaggcacctgcagggggacggtctcagcagcttcgactccagaggcagccggcccaccacagagactgagttcatcgcctgggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccaccagtcccagcaacaacggggaagtcacccagcccccaaggattctgggggaggcctcaggtctggctgtccatcagatcatcaccatcaccgtctccctcatcatggtcatagctgctctcatcacaactcttgtcttaaaaaattgctgtgcccaaagcgggaacactcgtcggaacagccaccagcggaagaccaaccagcaggaggagagctgccagaacctcacggacttcccctcggcccgggtgcccagcagcctggacatattcacggcctataacgagaccctgcagtgttctcacgagtgcgtcagggcatctgtgcccgtgtacaccgatgagacgctgcactcgacgacgggggagtacaaatccacatttaatggaaaccgaccctcctcttctgatcggcatcttattcctgtggccttcgtgtctgagaaatggtttgaaatctcctgctgactggccgaagtcttttttacctcctgggggcagggcagacgccgtgtgtctgtttcacggattccgttggtgaacctgtaaaaacaaaacaaacaaaacaaaacaaaaaagacaaaacctaaaactgagctatctaagggggagggtccccgcacctaccacttctgtttgccggtgggaaactcacagagcaggacgctctaggccaaatctatttttgtaaaaatgctcatgcctatgggtgactgccttctcccagagttttctttggagaacagaaagaagaaaggaaagaaaggaaccagaggcagagagacgaggatacccagcgaaagggacgggaggaagcatccgaaacctaggattcgtcctacgattctgaacctgtgccaataataccattatgtgccatgtactgacccgaaaggctcggccgcagagccggggcccagcgaatcacgcagagaaatcttacagaaaacaggggtgggaatctcttccgatagagtcgctatttctggttaatatacatatataaatatataaatacaaacacacacacacactttttttgtactgtagcaatttttgaagatcttaaatgttcctttttaaaaaaaagaattgtgttataggttacaaaatctgatttatttaacatgcttagtatgagcagaataaaccagtgttttctactttggcaactcacgtcacacacatattacacacatgtgcgcatacacacacacaatacacatacatgcatatagacgcatctattggaaatgcagttccacaggtgagcatgttctttctggtgacctggtattccatcaccattcaccccaggggacagcctcgaccgagacaaggaggcccttaaatgacagcctgcatttgctagacggttggtgagtggcatcaaatgtgtgacttactatcttgggccagaactaagaatgccaaggttttatatatgtgtgtntatatatatatatatatatatatatatatatatatatatgtttgtgtgtgtatatatatatatatatatatatgtttgtgtgtgtatatatatgtttgtgtatatatatacacatatgcatacatatgattttttttttttcatttaagtgttggaagatgctacctaacagccacgttcacatttacgtagctggttgcttacaaacgggcctgagcccctggttgggtgggtggtggattcttggacgtgtgtgtcatacaagcatagactggattaaagaagttttccagttccaaaaattaaaggaatatatcctta

SEQ ID NO: 377657 - DNA, 2386 bp, Homo sapiens
cacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggaggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcagctccatgtccatccgctggccgggccgccccctcggaagccatgcctggatactgatagccatgtttcagctcgccgtggacctgcccgcctgtgaggccctgggcccggggccggagttctggctcctgccgcggtcgccgccccggccgccccggctgtggagttttaggagtggacagccagcgcgggtcccggccccggtgtggagcccccggccgccccgagtggagcggatccacgggcagatgcagatgcctcgagccagacgggcccacaggccccgggaccaggcggccgccctcgtgcccaaggcaggactggccaagcccccagctgctgccaaatccagcccttccctcgcctcttcgtcctcgtcctcgtcctccgcggtggccggtggggccccggagcagcaggccctcctgaggaggggcaagaggcacctgcagggggacggtctcagcagcttcgactccagaggcagccggcccaccacagagactgagttcatcgcctgggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccaccagtcccagcaacaacggggaagtcacccagcccccaaggattctgggggaggcctcaggtctggctgtccatcagatcatcaccatcaccgtctccctcatcatggtcatagctgctctcatcacaactcttgtcttaaaaaattgctgtgcccaaagcgggaacactcgtcggaacagccaccagcggaagaccaaccagcaggaggagagctgccagaacctcacggacttcccctcggcccgggtgcccagcagcctggacatattcacggcctataacgagaccctgcagtgttctcacgagtgcgtcagggcatctgtgcccgtgtacaccgatgagacgctgcactcgacgacgggggagtacaaatccacatttaatggaaaccgaccctcctcttctgatcggcatcttattcctgtggccttcgtgtctgagaaatggtttgaaatctcctgctgactggccgaagtcttttttacctcctgggggcagggcagacgccgtgtgtctgtttcacggcggttgtccggaatgccagtggctcctgggcagatgtgcaccccagattcagcctttgtgatagattccaacacgttctggcctcagaccacctttgtggtggggccagactgctctgggcaaagtgaagctggcctttatgctccaaggaagggggcctcgagagcaggcctgcattggctctcggactaattcgcgatcatctttcatacagcaggtacacttcagcaaacctcgttaatgttgatctctttccctttgccaaggccgcttcgttctgaacggagcctgcaaagtcataaaagctcttgaatccgaagcaagtgagaaataaatcatgcactattattattttcaaaaacacattgatcactaataaaaaataagaagtgtacct

SEQ ID NO: 377658 - DNA, 3235 bp, Homo sapiens
  misc_feature (2914)..(2914): n is a, c, g, or t
cacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggaggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcagctccatgtccatccgctggccgggccgccccctcggaagccatgcctggatactgatagccatgtttcagctcgccgtggacctgcccgcctgtgaggccctgggcccggggccggagttctggctcctgccgcggtcgccgccccggccgccccggctgtggagttttaggagtggacagccagcgcgggtcccggccccggtgtggagcccccggccgccccgagtggagcggatccacgggcagatgcagatgcctcgagccagacgggcccacaggccccgggaccaggcggccgccctcgtgcccaaggcaggactggccaagcccccagctgctgccaaatccagcccttccctcgcctcttcgtcctcgtcctcgtcctccgcggtggccggtggggccccggagcagcaggccctcctgaggaggggcaagaggcacctgcagggggacggtctcagcagcttcgactccagaggcagccggcccaccacagagactgagttcatcgcctgggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccaccagtcccagcaacaacggggaagtcacccagcccccaaggattctgggggaggcctcaggtctggctgtccatcagatcatcaccatcaccgtctccctcatcatggtcatagctgctctcatcacaactcttgtcttaaaaaattgctgtgcccaaagcgggaacactcgtcggaacagccaccagcggaagaccaaccagcaggaggagagctgccagaacctcacggacttcccctcggcccgggtgcccagcagcctggacatattcacggcctataacgagaccctgcagtgttctcacgagtgcgtcagggcatctgtgcccgtgtacaccgatgagacgctgcactcgacgacgggggagtacaaatccacatttaatggaaaccgaccctcctcttctgatcggcatcttattcctgtggccttcgtgtctgagaaatggtttgaaatctcctgctgactggccgaagtcttttttacctcctgggggcagggcagacgccgtgtgtctgtttcacggattccgttggtgaacctgtaaaaacaaaacaaacaaaacaaaacaaaaaagacaaaacctaaaactgagctatctaagggggagggtccccgcacctaccacttctgtttgccggtgggaaactcacagagcaggacgctctaggccaaatctatttttgtaaaaatgctcatgcctatgggtgactgccttctcccagagttttctttggagaacagaaagaagaaaggaaagaaaggaaccagaggcagagagacgaggatacccagcgaaagggacgggaggaagcatccgaaacctaggattcgtcctacgattctgaacctgtgccaataataccattatgtgccatgtactgacccgaaaggctcggccgcagagccggggcccagcgaatcacgcagagaaatcttacagaaaacaggggtgggaatctcttccgatagagtcgctatttctggttaatatacatatataaatatataaatacaaacacacacacacactttttttgtactgtagcaatttttgaagatcttaaatgttcctttttaaaaaaaagaattgtgttataggttacaaaatctgatttatttaacatgcttagtatgagcagaataaaccagtgttttctactttggcaactcacgtcacacacatattacacacatgtgcgcatacacacacacaatacacatacatgcatatagacgcatctattggaaatgcagttccacaggtgagcatgttctttctggtgacctggtattccatcaccattcaccccaggggacagcctcgaccgagacaaggaggcccttaaatgacagcctgcatttgctagacggttggtgagtggcatcaaatgtgtgacttactatcttgggccagaactaagaatgccaaggttttatatatgtgtgtntatatatatatatatatatatatatatatatatatatatgtttgtgtgtgtatatatatatatatatatatatgtttgtgtgtgtatatatatgtttgtgtatatatatacacatatgcatacatatgattttttttttttcatttaagtgttggaagatgctacctaacagccacgttcacatttacgtagctggttgcttacaaacgggcctgagcccctggttgggtgggtggtggattcttggacgtgtgtgtcatacaagcatagactggattaaagaagttttccagttccaaaaattaaaggaatatatcctta

SEQ ID NO: 377659 - DNA, 545 bp, Homo sapiens
aagcatgaagtgcctaacccagcttagcggtgtagaggtggggtcagcaaataagggagatcttcctggagaaggcatatacctaagctgatttaggagagaccacttttggctaggtttattgtactacttgattttcaagtaattgggcttatttattctagagaaaaagtcttcagtctcttgcttctgcctgcaaagcaaggcagagtcagcaacatgggcagtctccccactggagaacgctgagtcatgcatgggcttctccaagtttccatcagatgggatccagtgttgaatccagtgcaggactggagtctagctggcaaagggtaaatgcccccaaagccttcctgccatatggtttccacgaaggcctgagagtcagctgtacaactgtcttgtcttggccatgtccctgtttggtccctgccttgttctcttccctttctcaatttccaagctccacccactcctaaaaacaccagtcattctgaagtaaaaaatggacaataaacatgaatattcaagattcaaaaacactt

SEQ ID NO: 377660 - DNA, 1412 bp, Homo sapiens
  misc_feature (21)..(21): n is a, c, g, or t
  misc_feature (411)..(411): n is a, c, g, or t
tcaacgctttatacttcaaantataaatataggtaggttaaaataaaaagaatagaaaaagataaattatgcaaagataaaagaaagcaagggtgttttacttcaaataaagcatatttcagagcaaataaaattatcagagatagagtaggacgtgacataataattaaagcatcaatccactaagacacagcaatcctaaatgtccatgtaccagacaacggaactacaaaatacatgaagcacaaaccaatagaactaaagacaaacccacaatgagataccatttcacaccagttagaatggcgatcattaaaaagtcaggaaacgaaagatgctggggaggatgtggagaaacaggaacgctttcacactgctggtgagtatgtaaattaggaagtataaagcgtngagctcaacgctttatacttcgaagaagtgacaggtagaatttgtagattttagtacaaactccattctgaaccattaaaacttagaaactttggaggaaacattaggaagcttgactgtcccataatttctgtggttgttttgctcatacagatatattagcatctagaattcttatgtcctgttgttcactcttagatatttaatacaagatgcatttcatttgaaattttactgtttggatgcttggatgggtcatttaactttgttctgtttcttatgagtgggactgggagagaaggttgggtggctagctcagaatactaaagattacttggagtgcagatgctatcatgtggatcatttgttcaattcagtggagtattggtcatatctgtgtgtcccagtgcaagatcaatcagacatggaacctgttcttagagaccttgcagtctgctagataagacatgtatatatgtatatgtgttggaatgggtgggttgggcagagtaggagacttgagaaagtgatgactaggaacaaggtgagccaacgttgtgcctaacacagtaagcctgggaagtatttattgtgattcagtgggtaacattaaattgataacatttggatatgcaaaaatgaagtgaaggagaggctggaatttttagttgaaggaaggaaaagcacagaggcagaagaatttgagggccatatagtccagaaatgataacggagatgcaggttggaggtatatcctaaagtgctctgaattccaggctgagaagtttcttcaaaagttttcaagctgggaagtaatataattagagaaatgttttaggaaaatgaacctttcagaagtttttaagctctggacttggccagagggtggggaaagtcaatggagaaaaggatgagttaacacaatgaagatcaacatgtctttcacaggggaagaccacaaaacccctctgtagttgcatagtgtgctgacattttttatt

SEQ ID NO: 377661 - DNA, 393 bp, Homo sapiens
gtgtgcttgtgattgccccgcccttctaggatctgagtgatgagacgtgtccccactgaggtgccccacagcagcaggtgttgagcatgggctgagaagctggaccggcaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgttta

SEQ ID NO: 377662 - DNA, 224 bp, Homo sapiens
tgagatggagtttcgcactgtcatggggctggagtgcagtggcacaatctcggctcactgcaacctccgcctcccaggttcaagcaattctcctccttcagcctcccgagtagctgggattatgtcgtcttatttatttagcggggtgaatattttatactgtaagtgagcaatcagagtataatgtttatggtgacaaaattaaaggctttcttatatgttta

SEQ ID NO: 377663 - DNA, 3386 bp, Homo sapiens
gcaaggaagggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttaaaaaaaaagtcgagcggccgctaatttagtagtagtagtaggc

SEQ ID NO: 377664 - DNA, 3918 bp, Homo sapiens
gcaaggaagggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttattggcatgtgtttcttttaggagggggaaagacctgatctttctacaacattcttaactctcagttcagggagccctttggcttttgacagcttcacttcccagtggccaccagcaggtggaggcatagaccagcactctttgtgtcaattgccaattgtggggggttgtgctgcaccttggactggggggtttcggagttggggagagggggtcagaaagagtctgaagtgtggggcaatggtggcattttccttctaaaagacccctgagtagggatgggcatgatgactcacgcctgtaatcccagcactttgggaggctgaggcaggtggatcacttgaggtcaggagttccgagaccagcctggccaacatgatgaaaccctgtctctactaaaaatataaaaaattagccaggtgtggtggtgcgtgcctgtaatcccagctactcgggaggctgaggcaggagaatcgcttgaatccaggaggtggaggttgcagtgagccgagatcgtgccattgcactccatcctgggtgacaagagtgaaactccatctcaaaaaatgaaaaaaa

SEQ ID NO: 377665 - DNA, 3343 bp, Homo sapiens
gcaaggaagggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgttta

SEQ ID NO: 377666 - DNA, 3166 bp, Homo sapiens
caggctctggagtcacactgcttgttgaaacgctgcctcttaccctccctaggtctgcgcctttgaataagtatcacttcttagttgatctccatgcctcatgtttgtccatctgaaaatgggggcatctgtaatgcctgtgttatgaggagtaaattacagcatccctgtgaagacgtagcacagtgtcgagtacggaatgttatttccatccttctcacggagcttggttccccttccccttgccctttacttgtcccagccattgactcatactacttcccttcttgcaggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgttta

SEQ ID NO: 377667 - DNA, 337 bp, Homo sapiens
gggcactggttagctgtgttgcttggagaccccatcagccctgggtgcccctcacatgactcgtcactgtgcagtggccgtgtaattgcctctccatctcctctagacagtgaactccatgaagaagggacacagtctgtcttagtgctattgccccagtgcccaggctggccctggcacatagtagagcctcagggaactttgttggatggttgaaggatggacagataacatgttggagtccttcaagaatcctgaggattacctgggcttgttggcatgtgcctgtagtcccagccactcaggaggctgaggcaggaggatcatcagagcctgg

SEQ ID NO: 377668 - DNA, 5036 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377669 - DNA, 5236 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377670 - DNA, 5487 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggacaggacggggagtgggggctgatggccatggtatgatagaacctcccccatcctgaccaggtatgtagccctgacatcactgcttcgactggtgcagtctgatcacagtgctgtgcagcggcatcggcccactgtggtggaatgtctacgggaaactgatgcctccctcagccggtgagcagtgatagaggggacaggagggcagggcagaggttcccagtgccctgtggccaagactcgagccagtttagagcagctggagtaaggggactaagggggacaggtccctggggaagcagagggcctgaggcatggaccaggatgacctgggctacctgcatggaaacctctttctcctgccaggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377671 - DNA, 5117 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggtgaggcaggggccagtcagagagctgggcagaagtggtcaagattcaccacactgacttggccatgcccacaccttccaggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377672 - DNA, 4931 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377673 - DNA, 5396 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggtgagcagtgatagaggggacaggagggcagggcagaggttcccagtgccctgtggccaagactcgagccagtttagagcagctggagtaaggggactaagggggacaggtccctggggaagcagagggcctgaggcatggaccaggatgacctgggctacctgcatggaaacctctttctcctgccaggagagccctggaactaagcctggctctggtaaatagctccaatgtgcgagccatgatgcaagagctgcaggcctttctggagtcctgccctcctgacctacgggctgactgtgcctcaggcatcctgctggctgcagagagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377674 - DNA, 5288 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagagacaccatcctgcatgtgctgacaacggtgaggcaggggccagtcagagagctgggcagaagtggtcaagattcaccacactgacttggccatgcccacaccttccaggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377675 - DNA, 4546 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggtgagcagtgatagaggggacaggagggcagggcagaggttcccagtgccctgtggccaagactcgagccagtttagagcagctggagtaaggggactaagggggacaggtccctggggaagcagagggcctgaggcatggaccaggatgacctgggctacctgcatggaaacctctttctcctgccaggagagccctggaactaagcctggctctggtaaatagctccaatgtgcgagccatgatgcaagagctgcaggcctttctggagtcctgcccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377676 - DNA, 4996 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaactccgcctcccggattcaagcgattctcctgcctcagcctcc

SEQ ID NO: 377677 - DNA, 783 bp, Homo sapiens
ggcaacgtgtgcctttggaggatctgcgcgctgtagcgtctccttcccattctccaagtatctgcggagcaactccaggcactcgcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377678 - DNA, 4934 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacaactggggaccagcccccttctcccacaaataaagcccaataaagcctgagaagtgaggaaagccaaaaaaaaaaatatttg

SEQ ID NO: 377679 - DNA, 4398 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggtgagcagtgatagaggggacaggagggcagggcagaggttcccagtgccctgtggccaagactcgagccagtttagagcagctggagtaaggggactaagggggacaggtccctggggaagcagagggcctgaggcatggaccaggatgacctgggctacctgcatggaaacctctttctcctgccaggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggtgaggcaggggccagtcagagagctgggcagaagtggtcaagattcaccacactgacttggccatgcccacaccttccaggcgggcacccatgtgcgggatgatgcagtggccaacctgacccagctgattgggggggcccaggagctacatgcctactctgtgcgccgcctctacaatgccctggcagaagacatttcccagggtaccattcccacctacctaggcccagggctgcccaa

SEQ ID NO: 377680 - DNA, 2920 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacaggtactggccaggaatacctccctcctgagcttgatgaaggctagtggggcagagtcccagactctctcacctgtttatgccctggttttttaaattctacaatttcagagtcttcacagcctgcactgcaaacctctttccccattgctacccctactggtcatcagctggcctgaacccttcattctctggccagcctcctttagggcaggcatctcctcctctccgctcccatcctcctcaactcctagttcctcctacccactaacgcctgaatttcctaagcttctcctcttgttgaagggagagtgatgagatatgatgccccacaggttaatctggttttaaagaggaagatggaacagggatgtgagtgtc

SEQ ID NO: 377681 - DNA, 3375 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcctggaagacagggtcagtggggaaggaatggggctttagctggagaggat

SEQ ID NO: 377682 - DNA, 370 bp, Homo sapiens
gcttgttggcatgtgcctgtagtcccagccactcaggaggctgaggcaggaggatcatcagagcctgggaggtcaaggctgcagtgagctttgggcgacagagtgagaccctgtatcaaaaaaaggagacctgaggagggccttgagcagatacatctcctctctcatccactcaggtggccactaacacggacaccagccgaaatgccggaaatgcggtcctgtttgagacagtactcaccatcatggatatccgctctgcagctggcctacgggtatcaccccttatgcctctcccactacggccccgcccaccacctcacccacacaggtcctgcttgctggtttctccctcctagccccatcatct

SEQ ID NO: 377683 - DNA, 2490 bp, Homo sapiens
ggcacgaggaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagttaaaaaaaaaaaaaaaaaaaaactcagactagttctctctccctcgtgccgaattcggcacgacgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacaactggggaccagcccccttctcccacaaataaagcccaataaagcctgagaagtgaggaaagccaaaaaaaaaaatatttg

SEQ ID NO: 377684 - DNA, 5425 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggtgagcagtgatagaggggacaggagggcagggcagaggttcccagtgccctgtggccaagactcgagccagtttagagcagctggagtaaggggactaagggggacaggtccctggggaagcagagggcctgaggcatggaccaggatgacctgggctacctgcatggaaacctctttctcctgccaggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377685 - DNA, 5257 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaagtaagaaggggtcccagccccttgagagatggcctgtcactgggtccacccatttttgagtttctttccaggcatacatgcccagccctccctaccccctagcccttaggttcttgtttttgagccaaatctgggtatttccctgctccgtgggcctttccttcttgccacatcctgcagtggcacactgccatagccacttacatactacactggcccagccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377686 - DNA, 5480 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggtgagcagtgatagaggggacaggagggcagggcagaggttcccagtgccctgtggccaagactcgagccagtttagagcagctggagtaaggggactaagggggacaggtccctggggaagcagagggcctgaggcatggaccaggatgacctgggctacctgcatggaaacctctttctcctgccaggagagccctggaactaagcctggctctggtaaatagctccaatgtgcgagccatgatgcaagagctgcagggcagaggttcccagtgccctgtggccaagactcgagccagtttagagcagctggagtaaggggactaagggggacaggtccctggggaagcagagggcctgaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377687 - DNA, 5313 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggtaaggctgtggggccccccatcctttgcttcaggtctatggacagaagaattgaaaatcggatgggaaccccagctcacaggagaagggtagtgcacacacacaggcacacacgcaatagactctcttgcccctggcccccaccattcacttccccgacgctgaccccaggcatcctgctgggcaccatcacgctgatcacggagctctgcgaacgaagccctgcagccctcaggcacttccgaaaggtgggctggtgaaggggcaggccctgggcgtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtgaggtgcccaggagtcgaagagggtagaatctggggagcgtcagtaccaggactgatgagccatatatcccctaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377688 - DNA, 1341 bp, Homo sapiens
ttcgagcatcggtaccccgggaaattcgtgctgcgtgctcaatagacaccatcactgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377689 - DNA, 5254 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaaggtttgtaaagatcagagttcagaggtggcctggggactccaggagaaaaggccactaagtggaggaggtgggtgggagacagtgtgagatgggattgagtcatctggagatcagcacttggggagttacaggaaaagggtgtggagccactgagtatagaggggctgcctgagccctacctactgccatactgtgctctgttaaactcctgtgttcagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377690 - DNA, 5341 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaaggtttgtaaagatcagagttcagaggtggcctggggactccaggagaaaaggccactaagtggaggaggtgggtgggagacagtgtgagatgggattgagtcatctggagatcagcacttggggagttacaggaaaagggtgtggagccactgagtatagaggggctgcctgagccctacctactgccatactgtgctctgttaaactcctgtgttcagagtctccagctgcagctgcaggcccccagtgggaacacagttccagctcggggtggccttcctatcacccagctcttcagaatcctcaatcctaacaaggtgagcttcaggagttcccccaagacaagacccagggatagaagaagccgtgggtgctaaccctggtccctgctctcctattcctaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccaaaaaaaaaaatatttg

SEQ ID NO: 377691 - DNA, 4275 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaagtaagaaggggtcccagccccttgagagatggcctgtcactgggtccacccatttttgagtttctttccaggcatacatgcccagaactggggaccagcccccttctcccacaaataaagcccaataaagcctgagaagtgaggaaagccaaaaaaaaaaatatttg

SEQ ID NO: 377692 - DNA, 4158 bp, Homo sapiens
  misc_feature (2124)..(2124): n is a, c, g, or t
agctcggtacctacttttcacagggggggacccacaccacccgcaatgccgctgtctctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccngtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaagtgagagggttctggcaatcacttggaatcagggagatgggagagtagggaccttggaaatcccaggggactgcctgttgtgggtattgaaaaggactgattttctcagaggtttgactgaccgtcctcccaaaccctgcagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggtgaggcaggggccagtcagagagctgggcagaagtggtcaagattcaccacactgacttggccatgcccacaccttccaggcgggcacccatgtgcgggatgatgcagtggccaacctgacccagctgattgggggggcccaggagctacatgcctactctgtgcgccgcctctacaatgccctggcagaagacatttcccaggtcacagctgcttacacagtgcagaagacatctgagcacagagccctgtttttaagaacatctgggcttttgtcctgactctggtacctcctggttatgtaactacagatgactaacttcccttatgctccatgtaccctgactgcctcttagagctgccttgagattaaagctcttgtgtttatga

SEQ ID NO: 377693 - DNA, 1110 bp, Homo sapiens
tcgatgacgaggcccaggaagcacgctgaaaccctgggcggcggcaagctgtgcgacctcttctgcggccggcctgggcaggtgtctctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377694 - DNA, 4982 bp, Homo sapiens
tcgatgacgaggcccaggaagcacgctgaaaccctgggcggcggcaagctgtgcgacctcttctgcggccggcctgggcaggtgtcttcctcgagaggcaggcaggggatcccggacactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccagccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377695 - DNA, 5152 bp, Homo sapiens
  misc_feature (12)..(12): n is a, c, g, or t
ctctgtctcaanaaaacaaaaaacccaaaaataggggggagattcgttaaaatacctgtttttaaattgactttattgagctataaatcacatactatataatccacccatttaaagtgtccagttccaccaggtgctgggattacaagcgtgagccattgcgcctggctccaaatctgatttgagtgtaaaaagttagacacaccataagctgtaggtttattactgggtggtgaaaaacaattcaggttttctttataatagtgattatgaagtgttcttcccagactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccagccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377696 - DNA, 6914 bp, Homo sapiens
tcgatgacgaggcccaggaagcacgctgaaaccctgggcggcggcaagctgtgcgacctcttctgcggccggcctgggcaggtgtctccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttcactctctttctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtggctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagcctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagctcagttgttcaaggctatgtactaaaaataaaactagccaggcatggtggtacacgcctgcagtcccagctacttggagggctgaggcaagaggatcgtgaggtggcagtgagttatgatcgagccactgtactccagcctgggtgacagagcaagaccttgtctcaaaattatacatgttaatatattctagtttaatattgcaaacatctttagaatttcatcagaaacgtgattttttctaagaaatgcaaaaggattttaggatttttaacacagaggacatgtttaacaaatgaatcctgacagacacctgcagtttagaataaatttgtgaacatccatgcgtataaagtgtcctcttgggacaagacatgttcacactgacttggggaatatgcccccaaggtgagagctgtcttttgaactgtgatctgactctgaaaagtagtgaatgccccaggtgatagactgtaactgtgagtggaattaatgctgcttgcatgccttttaatccaaaaccaaattcttttaaaaaatttttaaataaaatttcacctttgtattctttcattacagatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377697 - DNA, 5048 bp, Homo sapiens
tcgatgacgaggcccaggaagcacgctgaaaccctgggcggcggcaagctgtgcgacctcttctgcggccggcctgggcaggtgtctccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttcactctctttctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtggctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagcctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagctcagttgttcaaggctatgtactaaaaataaaactagccaggcatggtggtacacgcctgcagtcccagctacttggagggctgaggcaagaggatcgtgaggtggcagtgagttatgatcgagccactgtactccagcctgggtgacagagcaagaccttgtctcaaaattatacatgttaatatattctagtttaatattgcaaacatctttagaatttcatcagaaacgtgattttttctaagaaatgcaaaaggattttaggatttttaacacagaggacatgtttaacaaatgaatcctgacagacacctgcagtttagaataaatttgtgaacatccatgcgtataaagtgtcctcttgggacaagacatgttcacactgacttggggaatatgcccccaaggtgagagctgtcttttgaactgtgatctgactctgaaaagtagtgaatgccccaggtgatagactgtaactgtgagtggaattaatgctgcttgcatgccttttaatccaaaaccaaattcttttaaaaaatttttaaataaaatttcacctttgtattctttcattacagatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaaccagtccgttcgactgagcagcagagatgtgaatgttgaagtagaggaggtagagtgtggaaagaacac

SEQ ID NO: 377698 - DNA, 6570 bp, Homo sapiens
ctctttgcagtcttaaaaattgaagcccacaaacagctcttacttaaggtgattatatttattgatacttacatattaggagttaaaacaaatttaaaacatacgagtactgtacacgcaagcatgcatcccctgagtctgagtgaggctgtcactctagcatctggaatgctccgttgtatattcaggaggggacagtgaaaaagacaaataataatgtctttgtattatgaaaagttttgatctcatagatctcctgaaagtctcaggtatcccccgggggtccctgggccacactgtaaggaactgctgcctactttttcccatggaatgtgaatcaaaacctgttgaattttagctgtaacttaagcctagtttatatttgtaaaaagaaaatgtacagaagattgtttacataatgatatacaactttaaatattttcagcatttaccttatatgatgggcatgaatctagaaacatgaataattatcagactagaaccttctaatttaaatatctaggcttcagcctgccattgttatagttcaatcgaaatgtgtctagctgattaaaatgtctactgaaagatttattaagttttattggccactctggccttgtattaatctaaagaggtctctaatgaaaaaaagtcaaattaacatgtttatgtctataaatgccacaagtaagttaaattacataactttgttagcactctgaataaaatgcctcataacttttgtaagttagccattgagtcctcaggaaaatgtatttcttttccttacagagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttcactctctttctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtggctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagcctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagctcagttgttcaaggctatgtactaaaaataaaactagccaggcatggtggtacacgcctgcagtcccagctacttggagggctgaggcaagaggatcgtgaggtggcagtgagttatgatcgagccactgtactccagcctgggtgacagagcaagaccttgtctcaaaattatacatgttaatatattctagtttaatattgcaaacatctttagaatttcatcagaaacgtgattttttctaagaaatgcaaaaggattttaggatttttaacacagaggacatgtttaacaaatgaatcctgacagacacctgcagtttagaataaatttgtgaacatccatgcgtataaagtgtcctcttgggacaagacatgttcacactgacttggggaatatgcccccaaggtgagagctgtcttttgaactgtgatctgactctgaaaagtagtgaatgccccaggtgatagactgtaactgtgagtggaattaatgctgcttgcatgccttttaatccaaaaccaaattcttttaaaaaatttttaaataaaatttcacctttgtattctttcattacagatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377699 - DNA, 2252 bp, Homo sapiens
tcgatgacgaggcccaggaagcacgctgaaaccctgggcggcggcaagctgtgcgacctcttctgcggccggcctgggcaggtgtcttcctcgagaggcaggcaggggatcccggacccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggactttttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatctacttgagcctgtgtgcccactgaagagatgaagaataaaagcctaagctctcatc

SEQ ID NO: 377700 - DNA, 5642 bp, Homo sapiens
tgaaagcacacccaattatttgtcggtgttaacaaaatggattccactgagcctccctacagccagaagagtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttcactctctttctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtggctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagcctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagctcagttgttcaaggctatgtactaaaaataaaactagccaggcatggtggtacacgcctgcagtcccagctacttggagggctgaggcaagaggatcgtgaggtggcagtgagttatgatcgagccactgtactccagcctgggtgacagagcaagaccttgtctcaaaattatacatgttaatatattctagtttaatattgcaaacatctttagaatttcatcagaaacgtgattttttctaagaaatgcaaaaggattttaggatttttaacacagaggacatgtttaacaaatgaatcctgacagacacctgcagtttagaataaatttgtgaacatccatgcgtataaagtgtcctcttgggacaagacatgttcacactgacttggggaatatgcccccaaggtgagagctgtcttttgaactgtgatctgactctgaaaagtagtgaatgccccaggtgatagactgtaactgtgagtggaattaatgctgcttgcatgccttttaatccaaaaccaaattcttttaaaaaatttttaaataaaatttcacctttgtattctttcattacagatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377701 - DNA, 5731 bp, Homo sapiens
tcgatgacgaggcccaggaagcacgctgaaaccctgggcggcggcaagctgtgcgacctcttctgcggccggcctgggcaggtgtctccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttcactctctttctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtggctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagcctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377702 - DNA, 439 bp, Homo sapiens
tgattatgaagtgttcttcccagactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccaggttagtcttgcctttcccattactcatgtgctttcgttgaaaccaaagactttttcttttgtgcccatttctactcactgcctggccgtctgcacgacgatctgtgtttcctggtagttctccagtctagtagctactataaactactctccctatttcccgctctgtggagatgtcgttccaacaggtcctctccactctaagaccctatcctctcagagaagcccctgagagccattagtacttttgccctgg

SEQ ID NO: 377703 - DNA, 4791 bp, Homo sapiens
tcgatgacgaggcccaggaagcacgctgaaaccctgggcggcggcaagctgtgcgacctcttctgcggccggcctgggcaggtgtctccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377704 - DNA, 5060 bp, Homo sapiens
gactcctgggctcaaaggatcttcccatcttggcctccaaagtgctgggattacaagcgtgagccattgcgcctggctccaaatctgatttgagtgtaaaaagttagacacaccataagctgtaggtttattactgggtggtgaaaaacaattcaggttttctttataatagtgattatgaagtgttcttcccagactagctttatcgtcatctgggaaattgttaaaaatgcaaattcgcaagtttgagagccatggttccaagaaactgcataagcatacgaaataagttgcagcctcccgacttataccctggtacttctagtctaaaacaggatttgactctactaatccagccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377705 - DNA, 4821 bp, Homo sapiens
tcgatgacgaggcccaggaagcacgctgaaaccctgggcggcggcaagctgtgcgacctcttctgcggccggcctgggcaggtgtcttcctcgagaggcaggcaggggatcccggacccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377706 - DNA, 4510 bp, Homo sapiens
tcgatgacgaggcccaggaagcacgctgaaaccctgggcggcggcaagctgtgcgacctcttctgcggccggcctgggcaggtgtctccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggacttcctgatgaaaacaaaggcgatatgcattatgatgctgagattatccttaaaagagaaactttgttagaaatacagaagtttctcaatggagaagactggaaaccaggtgccttggatgatgcactaagtgatattttaattaattttaagtttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttcactctctttctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtggctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagcctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagctcagttgttcaaggctatgtactaaaaataaaactagccaggcatggtggtacacgcctgcagtcccagctacttggagggctgaggcaagaggatcgtgaggtggcagtgagttatgatcgagccactgtactccagcctgggtgacagagcaagaccttgtctcaaaattatacatgttaatatattctagtttaatattgcaaacatctttagaatttcatcagaaacgtgattttttctaagaaatgcaaaaggattttaggatttttaacacagaggacatgtttaacaaatgaatcctgacagacacctgcagtttagaataaatttgtgaacatccatgcgtataaagtgtcctcttgggacaagacatgttcacactgacttggggaatatgcccccaaggtgagagctgtcttttgaactgtgatctgactctgaaaagtagtgaatgccccaggtgatagactgtaactgtgagtggaattaatgctgcttgcatgccttttaatccaaaaccaaattcttttaaaaaatttttaaataaaatttcacctttgtattctttcattacagatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggttgcagcgagcagagatcacaccactgcactccagcctgggcaacagagcgagactctgtctcaaaaaaaaaaaaaattttagtaaaaatcaagggtaagctaaaataagttttggttggtttattggttttggagatggagtctctactaaaaatacaaaaaattagccgggcgtggtggcaggtgcctataatcccagctactcgggaggctgaggcaggagactcacttgaacccggtgggcagaggttgcagtgagccatgattgggccattgcactctagcctgggcaacaagagcgaaactccgtctcaaaaaaacaaaaaacaaa

SEQ ID NO: 377707 - DNA, 6794 bp, Homo sapiens
tcgatgacgaggcccaggaagcacgctgaaaccctgggcggcggcaagctgtgcgacctcttctgcggccggcctgggcaggtgtcttcctcgagaggcaggcaggggatcccggacccttatacaggatgctgtgttctttgctcctttgtgaatgtctgttgctggtagctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgatgaaatatcagaatgttatcacaaacttgattctttaacttataagattgatgagtgtgaaaagaaaaagagggaagactatgaaagtcaaagcaatcctgtttttaggagatacttaaataagattttaattgaagctggaaagcttggactttttcatgattttgaaacatggaagtggcgattcgaagattcctttggagtggatccatataatgtgttaatggtacttctttgtctgctctgcatcgtggttttagtggctactgagctgtggacatatgtacgttggtacactcagttgagacgtgttttaatcatcagctttctgttcagtttgggatggaattggatgtatttatataagctagcttttgcacagcatcaggctgaagtcgccaagatggagccattaaacaatgtgtgtgccaaaaagatggactggactggaagtatctgggaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttcactctctttctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtggctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagcctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagctcagttgttcaaggctatgtactaaaaataaaactagccaggcatggtggtacacgcctgcagtcccagctacttggagggctgaggcaagaggatcgtgaggtggcagtgagttatgatcgagccactgtactccagcctgggtgacagagcaagaccttgtctcaaaattatacatgttaatatattctagtttaatattgcaaacatctttagaatttcatcagaaacgtgattttttctaagaaatgcaaaaggattttaggatttttaacacagaggacatgtttaacaaatgaatcctgacagacacctgcagtttagaataaatttgtgaacatccatgcgtataaagtgtcctcttgggacaagacatgttcacactgacttggggaatatgcccccaaggtgagagctgtcttttgaactgtgatctgactctgaaaagtagtgaatgccccaggtgatagactgtaactgtgagtggaattaatgctgcttgcatgccttttaatccaaaaccaaattcttttaaaaaatttttaaataaaatttcacctttgtattctttcattacagatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377708 - DNA, 6073 bp, Homo sapiens
tgaaatgcaacattaaaagaaatgatcagtgttttgtctgtttctctaaacagaatggtttagaagttcatggacctataaggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaattgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacgagagcatcccacggtggtacccagtcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctagaggaacaccagcacaaacgacagcctcaagtctccttcgagctttgtaaagtatactcttcactctctttctcttctctgcaagaattctgattactacaaaggtgccaacttcaacattcacatttcaacttcaacattcacatttttactgacaattagaattaacaaacacgttatatatgtaaaagcttttcatttcatcttctctttgatatttacatcccataaagtaagaagtgtttattttaagatgaacagatgacaggcatcactgattctggatagttaaggaggccagtttgaattggggacattgaaaaagaaattttattgttacaggcacttacgggaacccactaaccaatttacattgcctagtgaatccactagagttaaggccacccacttgatgcctccagcatcttcatgcagccatggagtatcgttaccaggatcagtctgactgacacctcagcttatctctacgcaggctgcccacaggtcactgtggctgtagtttcatcttttccacagctattactacgcctgcatccttattgttccttttactttgtttacttagagaaaactgaagactgccagggcaatttagataacatagcttgttatattggtaatctgttttacagagtcagtcgactgaaaatgactttattcttttcccccaccaattgaagtgcatgggctttttataaaacctattttttgtgttactcagaatcctagcagtggagactattagatattaccatatcttaattcatattatagcaaatcatattgtcttgtccataggaagtttgcatttttagagatctatacatagagaataccatgatgaggaagaagagagttgggtgtcttccttaactgcagacaggacatcagtcagcactttacattagcctttctgattatcaaaagcattcctcattttaaactttttaaaaagcaatgcataaattttgtacctgtccttagcagacttcacagacatcaggtgtcctttgttttaaccatattcacactacaagttatgttcaactgcttactaaaagtgataccagtcaggaataaagtctttaaattttcatgcagatatttgtatcccaagcacttgcttttttattttaatatgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagttcagttgttgaaatgcagaatacacatttttggatccaggaagtgttacttacgtgcctgtaacaatgtaattttaggccaggtgcagtggctcatgcctacagtcctagcactttggaaggttgagggaggatgatcgcttaagctcagttgttcaaggctatgtactaaaaataaaactagccaggcatggtggtacacgcctgcagtcccagctacttggagggctgaggcaagaggatcgtgaggtggcagtgagttatgatcgagccactgtactccagcctgggtgacagagcaagaccttgtctcaaaattatacatgttaatatattctagtttaatattgcaaacatctttagaatttcatcagaaacgtgattttttctaagaaatgcaaaaggattttaggatttttaacacagaggacatgtttaacaaatgaatcctgacagacacctgcagtttagaataaatttgtgaacatccatgcgtataaagtgtcctcttgggacaagacatgttcacactgacttggggaatatgcccccaaggtgagagctgtcttttgaactgtgatctgactctgaaaagtagtgaatgccccaggtgatagactgtaactgtgagtggaattaatgctgcttgcatgccttttaatccaaaaccaaattcttttaaaaaatttttaaataaaatttcacctttgtattctttcattacagatatccatttggggatgaagtctactttgacagctagcaaggcgacatgcaactgttgttgaatgatgacagcaattcaggaaagacttaaatatgaaagcaaattgaacacatcgggtgtttgttatcagaaaagagatgagatgagataagacttgtttattgactagccaatatgtcattaaaattaaggtttatattgtgaagcttttttgaaattttacttttttttgagagttttgctctgtcacccaggctggagtgaggtggtacaatctcggctcactgcaacctccacctcccaggttcaagagattctcctgcctcagtctcccgagtagctaggattacagatgtgcatcaccatgcctggctaatttttgtattttttagtagagatggggtttcaccatgttggtcaggctggtctcgaactcctgacctcaagtgacccgcccttgtcggcctcccaaagtgctgggattacaggcatgagccattgtgcccagcctatatagtgtgaagcttttaggaaaatcagaacagggtagacagctgttaaaaacaatgtttaaatggaataatgttgaatgtttacaggctgtaagaactattgtatacacaaaataatacacaaagtttgtactttgtgtacaaatacaaatttgtactttgtgtacaaataatacaaaaagtttgtatacacaaactttttacgttgtggtttggtatattgtcttaactgaattttcttataagaaccccatgaaacttacctgagtttttaaaatgctatccaggacatcataccttatagtatacatgaaacataatgtaatccaggttgtaatttagaacttttttttttttttagctgagcacttaatgtaattaattccaggttatgactcttaaaaaacattggccattagagaaatagttctatttgcccatccaaatcacctgaatgactttttgaaagaataggggtccacatccccagatcccatcccagctgtgcacagtctgaagcaagcagagtgaaacaagttggcaacttgttccaagcgtgggcctttgcagtctgtgatccagtgttactccaggtcccagtctgtcccatacttgtcttttgctacagttagttagttactttgttatcatccccttgtaaactgccttcaatatctgggataaggaagacaaagcttaatgacaactaaggttctagctgacatctttctttcatatttaatttttgtgagttttcatctgttttctgtttgtttatgtgtcctaggttcttgacctaaccacatgggttttgttttttgtttttatattagaacttagaaaagtttgttttacagcagtattatggaacagaagagaccattttaaataatttttttaaacagcccaaaacacacaaaagatacttgttttctagagacagggtcttgctctgtcacccaggctggagtgcagtggcacgatcatagctcagtgcagcctccacctcctgggctcaagtggtcctcctgcctcagcctcttaagcagttgggactacaggtgtgtgccagcatgcttgctttttttttttttttgagacagagtcttgctctgtcactcaggctggagtccagtggcttggtctcagctcactgcaatctctgcctcccaggggttcaagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaacctagatttttagtaagactattttatatacttttttacattgatcaagtacattatttttaccaaacaacattgtttcccactacatccatggttatgtataaaaaaacgccattgtcaattaagatgttaaaaaattatttccataagagtattaaattctaatctatgattcacttaacttcctactttataaacactaggtaaagtaatctcacaagctgccaaagaacacatcccaagcagtaatcacagacgatgaagcaccttacaggacccctccaccctcaaacgcgcatgtccagagaagtattaatgccttaatagactactgaaggttaactatttacatcattctaaaaatattttaagctgtattacagtgctataaattctccttttaaggaaaaaagtaatagattgtttccttaccgtgtttgaaaggaaaaaaaataaatccatagtaactaatggtctgccgattttttccctgaatttttaaactccaacaaagcattattttgcaaaaagtcctttagcccaaagtcagtgtctctgttttgatctctttgtaaaagaactctctgttcatccattctctttccctgggaccgtaaaataaggctgaaaaagtcttcatctggtactgtcggaccctttgtggtagcaggtggtggagcacatctttgatcatctaatctggatccctagaagtttatgagagagattaaaagacatactgtgggaaagaaagcaccaagctatgttaaatctctcagtcacaacaagaaaacgcagttgtaaacttttatttggggcttctcagaaattaatctttgtttttatattgttctctttagttcccagcctgatttctgaaagaaataatctttaaacctg

SEQ ID NO: 377709 - DNA, 2964 bp, Homo sapiens
aaaacaattcttaataaagtttgggataatatacagaccttgatcacaaacttcaaaatctcttgaggtgatacaactaaaagtcctgtgtagggaatcctacctacacgggccacttttttccttcatgtttttatccttcaaaaattttctgaaagacagcttactgttttgaattgtgaatgtaaatttaattttttaaagatgaagtgggttgataaaacagttactataatcagagtaacttgtggctagtagtcttttaataaagacaaaataaatgcaacatgttcttcccatgaagcccatgatgcaaaataatagctaacagcatatgcaaagttagtttccaatactgtatttttcagggcctttcctctaaatcaacagattgtttgtcaccaggactatttattatttcacttaatagattaacagtgaattcacagacatcaagtggggatatcaaagctttagccaaaagggtaaaaaccaatagtgttttggtcatctagaacattaaaaagaaaaaagagccatccttcaaacacaaacaaatgaaacagaaaataggtttataagaggtggaagagtcagaaaaattacatacacacattaacaacatagaacatggattacctttggaaagaatcatactgaaatgtttgcttttaataaattgaagatttttcatgtttacagatgtttgggtatgttcaataggagcttccaaaaatgtcaaactaattcagtcttgtgcaaataaaacctaaaaatagttttcagcagattttacagtgatattcttaggtatgagaagaatgcacacactctaaaaacaatgaaacagacaaaagtttgacaaatgattgcaccataaaacagtgttttatatacagtttacaagatacgatttcctgctataaattaatactgtactatatagtacttattatagtgaccttttttaaaagcaactgcggacagttgtctatcttttcacttataggatttatagaaatctatatgaatgaatccatttcaatgtctggtctgcaagagtacgaagacttgacttcacatactacttgatgggatggtttaatcctgggttagagtgctgactggctagagggagttttcccccatcagccctgtatgcactggacctccaagacaacaatgaaattaaagacaatttaatggtttgggtaatagatacaaataaaaccttaaattttgtaatcttaaatgcaataccaccataagtgaaagaagtaaacagtggggaaattcttagcagctgagaaactttctctccccatgctcatgatccagttaaaaatattttgagaaactatttacaatacaattcatcttttggaagagaaaagctcttggtcatgtcataagttaatttgaaccatactttgctaacactttatctcagtggtatataacggtgacaaccaaagctttccttcaaagtgatccatttgactgaggaccaatcaaatcagaatagcaactgcaatcccaaatgtccatagaacatgtccagtggtattcttagacttgactagacatcatcatacttggggagaaacagtctccctcaggatctcccaaaggtttcttttactctgggaaggaaaagtatgacattctcccagaacacttaagaaatgcaccacagtggtggtccatctctctccccaattcctgagtgagctcaaacactggggttttctttcacaataaaatactgctgaattaacagtaagatagaagactgtcaaacaagccagtgtgaaacacatcaagcacctccatttcatagtgtgaatatctgaggaggtagctcccatctttgaagtaatcattctagaactgataatctagccttaaaaacagtgcgttcatttctgcttgtgtgaagcatgggccacatgggactctactgacagggagtcatttgggtcatcagttcactataaatgacagggacatttgggtcaccagttcactataaagaggagaaacttagctccactgccatgaaacaccctgtcccacatttcaaacaggagattatctatagtgttcaccaggaaaaacaagcattgatgcgaaggcatggagatgtggagaagagaaatactgtattttaaaactgtgagttcaagggttagctgcaatgcttcttttagggaagaacttaaagctgtgggtttagtacagccctttaaagtaaatgcaaaaatattagcttttagcaaacaaaggcatataacatataaagaaaatattgtattgctcaggttttggtaaagatgtattaataatgcttacagataaaaataatgaaattagtgttgtaaatagccaaaatagccagatatttactagcgaactttgtatttatgtaaagtgtgcctgaacatataaaatgcattattaatgtaacagactgagccagtagaaaaagaatctctgtacaacagacaacagttgccaataatttaaatagtgtcagattccccaaattataaggtttgacatgatcttaccttctactatcatatacaaataaattaaccctacaaataatttttagcttaacttaaaatcgcacctagaaaggtatgggattatctgtacctattacaaaaacctgttaaaatcaagggctgctacaaagaatgaggtaaactgaagactctctccactatgcagccttcagataaatggcttttttttctattgggttctaggtttgcacaccacagtgttttgctagcaaagcattcagaattctcttccaggaactgtttgcatgtgtgtgtatataaatttacacacacatacacacacacacacacacacatatatacacactgtatactgcatcagcaaaatatatatattatatatatttatataatataaggaagatttccccca

SEQ ID NO: 377710 - DNA, 2131 bp, Homo sapiens
ccagcagtaccaaacttttccttacaacttagcaactctattccagcaaagtcccaggctagtcacatgccatgctaatttctgaatctgtcaccatgactctgtccaagtctggcttctgtcgagctctgaagccagaacgtgaaattggccccatgaaaccacatggcccgaaggatttatagaaatctatatgaatgaatccatttcaatgtctggtctgcaagagtacgaagacttgacttcacatactacttgatgggatggtttaatcctgggttagagtgctgactggctagagggagttttcccccatcagccctgtatgcactggacctccaagacaacaatgaaattaaagacaatttaatggtttgggtaatagatacaaataaaaccttaaattttgtaatcttaaatgcaataccaccataagtgaaagaagtaaacagtggggaaattcttagcagctgagaaactttctctccccatgctcatgatccagttaaaaatattttgagaaactatttacaatacaattcatcttttggaagagaaaagctcttggtcatgtcataagttaatttgaaccatactttgctaacactttatctcagtggtatataacggtgacaaccaaagctttccttcaaagtgatccatttgactgaggaccaatcaaatcagaatagcaactgcaatcccaaatgtccatagaacatgtccagtggtattcttagacttgactagacatcatcatacttggggagaaacagtctccctcaggatctcccaaaggtttcttttactctgggaaggaaaagtatgacattctcccagaacacttaagaaatgcaccacagtggtggtccatctctctccccaattcctgagtgagctcaaacactggggttttctttcacaataaaatactgctgaattaacagtaagatagaagactgtcaaacaagccagtgtgaaacacatcaagcacctccatttcatagtgtgaatatctgaggaggtagctcccatctttgaagtaatcattctagaactgataatctagccttaaaaacagtgcgttcatttctgcttgtgtgaagcatgggccacatgggactctactgacagggagtcatttgggtcatcagttcactataaatgacagggacatttgggtcaccagttcactataaagaggagaaacttagctccactgccatgaaacaccctgtcccacatttcaaacaggagattatctatagtgttcaccaggaaaaacaagcattgatgcgaaggcatggagatgtggagaagagaaatactgtattttaaaactgtgagttcaagggttagctgcaatgcttcttttagggaagaacttaaagctgtgggtttagtacagccctttaaagtaaatgcaaaaatattagcttttagcaaacaaaggcatataacatataaagaaaatattgtattgctcaggttttggtaaagatgtattaataatgcttacagataaaaataatgaaattagtgttgtaaatagccaaaatagccagatatttactagcgaactttgtatttatgtaaagtgtgcctgaacatataaaatgcattattaatgtaacagactgagccagtagaaaaagaatctctgtacaacagacaacagttgccaataatttaaatagtgtcagattccccaaattataaggtttgacatgatcttaccttctactatcatatacaaataaattaaccctacaaataatttttagcttaacttaaaatcgcacctagaaaggtatgggattatctgtacctattacaaaaacctgttaaaatcaagggctgctacaaagaatgaggtaaactgaagactctctccactatgcagccttcagataaatggcttttttttctattgggttctaggtttgcacaccacagtgttttgctagcaaagcattcagaattctcttccaggaactgtttgcatgtgtgtgtatataaatttacacacacatacacacacacacacacacacatatatacacactgtatactgcatcagcaaaatatatatattatatatatttatataatataaggaagatttccccca

SEQ ID NO: 377711 - DNA, 1023 bp, Homo sapiens
ccagcagtaccaaacttttccttacaacttagcaactctattccagcaaagtcccaggctagtcacatgccatgctaatttctgaatctgtcaccatgactctgtccaagtctggcttctgtcgagctctgaagccagaacgtgaaattggccccatgaaaccacatggcccgaaggaccaagtctttgcaaaacctatcaaatggatggatggcttcaagacagcagagaacccacaagcttgaagaggcctccggagagttcactcaggataaacggggtgctggcatcgtcctggtcctctctgtacagtaacagtgttacagccctgtgagttcagtagtaaaggatctggagtccatggggaaattctaaggagatcaatggaactgatatattatatagccaaatacttattaataaagtaaccatccttataaaggctgatttaggcaagcctctgccttcaggaggaagttcactgaaacaaacctggcagattgatgactctgtctttcaaatctccaggaaatatggtttcataatttttctttatcacctagccccaactttaattttcataattcagtgtgtaaagcactgtgccaggtttctagtgagtacacaatgaggaagccatactctttgcattcaagagtttatatagttatacaaaagcacttactaatgacaatatcagcaactaacatttgaatgcttactatgtgcttggaactttatctcctttaaaccaacaatagccccattaagtgggtaatattattagtcccattctacagatgaaaaaaccaaggctcacgtaagttacatgatttactaagggtcacacaactggaatggtggaattgagatttaatccaggcagtctatgcctgtttagcaagttctgttacagaagcataagaaaaagagacacaaagcacaaaagattagatatatttcaaatatgggaggactttaaaactgagaggaggtggtacagacacaaccggggcagggagc

SEQ ID NO: 377712 - DNA, 2910 bp, Homo sapiens
aaaacaattcttaataaagtttgggataatatacagaccttgatcacaaacttcaaaatctcttgaggtgatacaactaaaagtcctgtgtagggaatcctacctacacgggccacttttttccttcatgtttttatccttcaaaaattttctgaaagacagcttactgttttgaattgtgaatgtaaatttaattttttaaagatgaagtgggttgataaaacagttactataatcagagtaacttgtggctagtagtcttttaataaagacaaaataaatgcaacatgttcttcccatgaagcccatgatgcaaaataatagctaacagcatatgcaaagttagtttccaatactgtatttttcagggcctttcctctaaatcaacagattgtttgtcaccaggactatttattatttcacttaatagattaacagtgaattcacagacatcaagtggggatatcaaagctttagccaaaagggtaaaaaccaatagtgttttggtcatctagaacattaaaaagaaaaaagagccatccttcaaacacaaacaaatgaaacagaaaataggtttataagaggtggaagagtcagaaaaattacatacacacattaacaacatagaacatggattacctttggaaagaatcatactgaaatgtttgcttttaataaattgaagatttttcatgtttacagatgtttgggtatgttcaataggagcttccaaaaatgtcaaactaattcagtcttgtgcaaataaaacctaaaaatagttttcagcagattttacagtgatattcttaggtatgagaagaatgcacacactctaaaaacaatgaaacagacaaaagtttgacaaatgattgcaccataaaacagtgttttatatacagtttacaagatacgatttcctgctataaattaatactgtactatatagtacttattatagtgaccttttttaaaagcaactgcggacagttgtctatcttttcacttataggatttatagaaatctatatgaatgaatccatttcaatgtctggtctgcaagagtacgaagacttgacttcacatactatcccccatcagccctgtatgcactggacctccaagacaacaatgaaattaaagacaatttaatggtttgggtaatagatacaaataaaaccttaaattttgtaatcttaaatgcaataccaccataagtgaaagaagtaaacagtggggaaattcttagcagctgagaaactttctctccccatgctcatgatccagttaaaaatattttgagaaactatttacaatacaattcatcttttggaagagaaaagctcttggtcatgtcataagttaatttgaaccatactttgctaacactttatctcagtggtatataacggtgacaaccaaagctttccttcaaagtgatccatttgactgaggaccaatcaaatcagaatagcaactgcaatcccaaatgtccatagaacatgtccagtggtattcttagacttgactagacatcatcatacttggggagaaacagtctccctcaggatctcccaaaggtttcttttactctgggaaggaaaagtatgacattctcccagaacacttaagaaatgcaccacagtggtggtccatctctctccccaattcctgagtgagctcaaacactggggttttctttcacaataaaatactgctgaattaacagtaagatagaagactgtcaaacaagccagtgtgaaacacatcaagcacctccatttcatagtgtgaatatctgaggaggtagctcccatctttgaagtaatcattctagaactgataatctagccttaaaaacagtgcgttcatttctgcttgtgtgaagcatgggccacatgggactctactgacagggagtcatttgggtcatcagttcactataaatgacagggacatttgggtcaccagttcactataaagaggagaaacttagctccactgccatgaaacaccctgtcccacatttcaaacaggagattatctatagtgttcaccaggaaaaacaagcattgatgcgaaggcatggagatgtggagaagagaaatactgtattttaaaactgtgagttcaagggttagctgcaatgcttcttttagggaagaacttaaagctgtgggtttagtacagccctttaaagtaaatgcaaaaatattagcttttagcaaacaaaggcatataacatataaagaaaatattgtattgctcaggttttggtaaagatgtattaataatgcttacagataaaaataatgaaattagtgttgtaaatagccaaaatagccagatatttactagcgaactttgtatttatgtaaagtgtgcctgaacatataaaatgcattattaatgtaacagactgagccagtagaaaaagaatctctgtacaacagacaacagttgccaataatttaaatagtgtcagattccccaaattataaggtttgacatgatcttaccttctactatcatatacaaataaattaaccctacaaataatttttagcttaacttaaaatcgcacctagaaaggtatgggattatctgtacctattacaaaaacctgttaaaatcaagggctgctacaaagaatgaggtaaactgaagactctctccactatgcagccttcagataaatggcttttttttctattgggttctaggtttgcacaccacagtgttttgctagcaaagcattcagaattctcttccaggaactgtttgcatgtgtgtgtatataaatttacacacacatacacacacacacacacacacatatatacacactgtatactgcatcagcaaaatatatatattatatatatttatataatataaggaagatttccccca

SEQ ID NO: 377713 - DNA, 2950 bp, Homo sapiens
aaaacaattcttaataaagtttgggataatatacagaccttgatcacaaacttcaaaatctcttgaggtgatacaactaaaagtcctgtgtagggaatcctacctacacgggccacttttttccttcatgtttttatccttcaaaaattttctgaaagacagcttactgttttgaattgtgaatgtaaatttaattttttaaagatgaagtgggttgataaaacagttactataatcagagtaacttgtggctagtagtcttttaataaagacaaaataaatgcaacatgttcttcccatgaagcccatgatgcaaaataatagctaacagcatatgcaaagttagtttccaatactgtatttttcagggcctttcctctaaatcaacagattgtttgtcaccaggactatttattatttcacttaatagattaacagtgaattcacagacatcaagtggggatatcaaagctttagccaaaagggtaaaaaccaatagtgttttggtcatctagaacattaaaaagaaaaaagagccatccttcaaacacaaacaaatgaaacagaaaataggtttataagaggtggaagagtcagaaaaattacatacacacattaacaacatagaacatggattacctttggaaagaatcatactgaaatgtttgcttttaataaattgaagatttttcatgtttacagatgtttgggtatgttcaataggagcttccaaaaatgtcaaactaattcagtcttgtgcaaataaaacctaaaaatagttttcagcagattttacagtgatattcttaggtatgagaagaatgcacacactctaaaaacaatgaaacagacaaaagtttgacaaatgattgcaccataaaacagtgttttatatacagtttacaagatacgatttcctgctataaattaatactttattatagtgaccttttttaaaagcaactgcggacagttgtctatcttttcacttataggatttatagaaatctatatgaatgaatccatttcaatgtctggtctgcaagagtacgaagacttgacttcacatactacttgatgggatggtttaatcctgggttagagtgctgactggctagagggagttttcccccatcagccctgtatgcactggacctccaagacaacaatgaaattaaagacaatttaatggtttgggtaatagatacaaataaaaccttaaattttgtaatcttaaatgcaataccaccataagtgaaagaagtaaacagtggggaaattcttagcagctgagaaactttctctccccatgctcatgatccagttaaaaatattttgagaaactatttacaatacaattcatcttttggaagagaaaagctcttggtcatgtcataagttaatttgaaccatactttgctaacactttatctcagtggtatataacggtgacaaccaaagctttccttcaaagtgatccatttgactgaggaccaatcaaatcagaatagcaactgcaatcccaaatgtccatagaacatgtccagtggtattcttagacttgactagacatcatcatacttggggagaaacagtctccctcaggatctcccaaaggtttcttttactctgggaaggaaaagtatgacattctcccagaacacttaagaaatgcaccacagtggtggtccatctctctccccaattcctgagtgagctcaaacactggggttttctttcacaataaaatactgctgaattaacagtaagatagaagactgtcaaacaagccagtgtgaaacacatcaagcacctccatttcatagtgtgaatatctgaggaggtagctcccatctttgaagtaatcattctagaactgataatctagccttaaaaacagtgcgttcatttctgcttgtgtgaagcatgggccacatgggactctactgacagggagtcatttgggtcatcagttcactataaatgacagggacatttgggtcaccagttcactataaagaggagaaacttagctccactgccatgaaacaccctgtcccacatttcaaacaggagattatctatagtgttcaccaggaaaaacaagcattgatgcgaaggcatggagatgtggagaagagaaatactgtattttaaaactgtgagttcaagggttagctgcaatgcttcttttagggaagaacttaaagctgtgggtttagtacagccctttaaagtaaatgcaaaaatattagcttttagcaaacaaaggcatataacatataaagaaaatattgtattgctcaggttttggtaaagatgtattaataatgcttacagataaaaataatgaaattagtgttgtaaatagccaaaatagccagatatttactagcgaactttgtatttatgtaaagtgtgcctgaacatataaaatgcattattaatgtaacagactgagccagtagaaaaagaatctctgtacaacagacaacagttgccaataatttaaatagtgtcagattccccaaattataaggtttgacatgatcttaccttctactatcatatacaaataaattaaccctacaaataatttttagcttaacttaaaatcgcacctagaaaggtatgggattatctgtacctattacaaaaacctgttaaaatcaagggctgctacaaagaatgaggtaaactgaagactctctccactatgcagccttcagataaatggcttttttttctattgggttctaggtttgcacaccacagtgttttgctagcaaagcattcagaattctcttccaggaactgtttgcatgtgtgtgtatataaatttacacacacatacacacacacacacacacacatatatacacactgtatactgcatcagcaaaatatatatattatatatatttatataatataaggaagatttccccca

SEQ ID NO: 377714 - DNA, 733 bp, Homo sapiens
ccagcagtaccaaacttttccttacaacttagcaactctattccagcaaagtcccaggctagtcacatgccatgctaatttctgaatctgtcaccatgactctgtccaagtctggcttctgtcgagctctgaagccagaacgtgaaattggccccatgaaaccacatggcccgaaggaccaagtctttgcaaaacctatcaaatggatggatggcttcaagacagcagagaacccacaagcttgaagaggcctccggagagttcactcaggataaacggggtgctggcatcgtcctggtcctctctgtacagtaacagtgttacagcccttatcttggcagaattgatttggatggatcagagtgaatggagaccagttgaaggaagactggttcaatggctagagaatatgaatgttggtcttaagtccaaggcccacatgtcaaagacgagtgctctgctgatatctagttgagtgactttggaaaagtctgaggcctcgatttcctcacctggaaagtgaaaacactggacatgctctttgacatttcatccagcactgaaattttatagtcttgtgaaaaatctcttcttgaaatgttatcttgggtggtcttagattgtgtgtgactggaactggggctgatttgtaaaacccttgaatgtgcttgaaaataccaacccacagtgttttcttctcctgggaaaagaaccaaaactcttaaaaaatata

SEQ ID NO: 377715 - DNA, 758 bp, Homo sapiens
gccttagacaatattaaatatttaaacaacatgagaaagagtgccagaggtcagaacatagtatttagttcactgagttgccctgacagataatgaatggggattgatttaatagtgaccaaatacactggccatatttactaaagtgctgtaaaatggccaagtgaggacaactgcatctaaaatgagatcaaatcctcgagtccattccttttagcagaaatgattaaaaccatcttggcaggaccaagtctttgcaaaacctatcaaatggatggatggcttcaagacagcagagaacccacaagcttgaagaggcctccggagagttcactcaggataaacggggtgctggcatcgtcctggtcctctctgtacagtaacagtgttacagccctgtgagttcagtagtaaaggatctggagtccatggggaaattctaaggagatcaatggaactgatatattatatagccaaatacttattaataaagtaaccatccttataaaggctgatttaggcaagcctctgccttcaggaggaagttcactgaaacaaacctggcagattgatgactctgtctttcaaatctccaggaaatatggtttcataatttttctttatcacctagccccaactttaattttcataattcagtgtgtaaagcactgtgccaggtttctagtgagtacacaatgaggaagccatactctttgcattcaagagtttatatagttatacaaaagcacttactaatg

SEQ ID NO: 377716 - DNA, 196 bp, Homo sapiens
tcagtttccccaacgctcaccaggtatctgctgtgtgttggggaaactgaaaaacaagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377717 - DNA, 2515 bp, Homo sapiens
aaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377718 - DNA, 2483 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377719 - DNA, 2742 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaacaccacacaacaaacagaccaccacgccgacacacaccctcccagaaaaacggggcgccgcacaaaaacacccgagggcgcaagacggacccccccgctgagctagacggccccaagggagccgcacgcacagagcccgaaacaacggagcggcgtaaatcaggcacaggaacacaacagaggcgatgaacaccagaaaaccaggcataactgcttggtaacaacccgcaaccccgatagtatcagcgaccggcata

SEQ ID NO: 377720 - DNA, 2827 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaacaaaaaaaaaaaaacaaaacaacaaaaacaaaaaaaaaacaaaaaaaaaaaaaaaaaaaagaaaaacgtaggggagagcgcagcgcacggcgcgcggcgagagaagacagttgaacacacaccgcgccgtggggggcggcgccgcccgacaggagaggagcacacagcagccgcgaaaaaggcagcacgacgagggaaccacaagacgggcacaaccaacagagggcgagggtagcaacacacacaataaaaaacaccccgccggcggcgaccaaaacggagggcaaagaaacaaccaccagacgaagatcaacggagagaaaaagcgggggccccc

SEQ ID NO: 377721 - DNA, 2424 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagggggggggctaaattcctcgggggccaagttagggtcccggttttgttcaaggggcccatagggggattaaagaggaaggggggttaaacgtgggtggaaagggtggattgtggaggacccttggggtga

SEQ ID NO: 377722 - DNA, 2430 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagacatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377723 - DNA, 2038 bp, Homo sapiens
ccaactaaggctagtacgaggcgggtgttaatcggccgagggagaaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377724 - DNA, 2125 bp, Homo sapiens
gggacagtacaatggaggagctggaagatacaagccgaatggactaagccccacagtcttttactgaagtccttggcagagtctatcagaagttgaaatgtctcccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377725 - DNA, 2479 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagaggagaacagcacatagtgccagaagaaagatggcacttctgaaaacctgaattgttcaccgccaaacgggagtcccaggaaccaatccaacaggtatggagaaaggaacaacttgggaacaacagaaacgttttatttcacacacagaacaaacaggggcggcccccctttaactatgacgagcccgccgctcccttccgtctaacagcgctcctttctacaggagccgcattacgcgcaaatcaccacaacggcgcaacacaagaggacacgcgctctccctctaacaggcgcccttcacccaagtggccaca

SEQ ID NO: 377726 - DNA, 1922 bp, Homo sapiens
ccaactaaggctagtacgaggcgggtgttaatcggccgagggagacaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377727 - DNA, 2575 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactcttcctcactttattccattgggaggaattggcccctttggaaagaaacccaatcccttcctgggaaattggtgggttgttggttggcttgaattgtaccccgaacccagggttgatgtgggtccattcaaggttctccctgtgaaggaagaaaggctcccctcgaactggtctttgttccccagaaacctttttcattcccaaaaccgggaaatttcaggcacctgtttccgcggaagccttggaggaaagagggggcgccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377728 - DNA, 2407 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377729 - DNA, 2531 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgagggtgtggagcaccgttctggaatcccgttcgttgtttagcaagagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377730 - DNA, 2000 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377731 - DNA, 1550 bp, Homo sapiens
ccagctaacctacataaacggttcctcaagggtaggacggagggacccatgggatggccctgcagcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377732 - DNA, 1427 bp, Homo sapiens
cgctctagagtatccccacctcctaccccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377733 - DNA, 1531 bp, Homo sapiens
  misc_feature (1425)..(1425): n is a, c, g, or t
  misc_feature (1447)..(1448): n is a, c, g, or t
  misc_feature (1454)..(1454): n is a, c, g, or t
  misc_feature (1458)..(1458): n is a, c, g, or t
  misc_feature (1467)..(1467): n is a, c, g, or t
  misc_feature (1469)..(1470): n is a, c, g, or t
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgagtggctcccatgtgtcttcccgggtanggtcggtggcccaataccgggnnccccancggntttggagcnannctgtccgggatgcggggcccctttctcctacgcgggttgtcccatggcgacagtgcgctcg

SEQ ID NO: 377734 - DNA, 1775 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377735 - DNA, 1500 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377736 - DNA, 1232 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggacctgttgctcctcaggtcagcctgctgggacgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggcatcctggaccatactaccacgtcgcggaccatgcagagggcgcggagggcccagggcaggcgcctcgcaccgctgaccgtccaccagagcatatatcacaacctcccaaagctcgcacactagaccccagggctcccgagctactcgggcatcaggtggtgggcccagcacgcacacaggcatcccgtctgcccacggcccggccgccctcc

SEQ ID NO: 377737 - DNA, 899 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagtcagcatcgggtataggccgaaggagagactggaggcgtgcatcatctcttcaacctgtgcagaaatgactttgggcattcccataccgccatatgcgggatccccaccgacgccgac

SEQ ID NO: 377738 - DNA, 1037 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgtgagttgtcatctcgagcatttctcaggcttcatttgtctcgggtcctatccgaagagggctcattcattggttcagcaaatactttctgggcaagtacttgcagtaaatacttccgtgtgccaggtgctctgcaaggcaccgcagacatgattgcatgaaggcaagtaaggtccgtgtcctcgtggagctcacatggacacagtcttctgcaagcctcgcagacagaaggcaagcgctgagccagagcatgagcacaccaccacctagagatc

SEQ ID NO: 377739 - DNA, 735 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatcaaccaaggcagatgtgacagcaagggccacggaccccatggcaggggtggcgtcttcatgagggagggcccaaaacccttgtgggcggacctcccctgagcctgtctgagggccagcccttagtgcattcaggctaaggcccctgggcagggatgccacccctgtccttcggaggacgtgccctcacccctcactggtccactggcttgagactcaccccgt

SEQ ID NO: 377740 - DNA, 356 bp, Homo sapiens
ctggtgagctcagatagtctctttctctgacactgtgtaagaagctgtgaatattcctaacttacccagatgttgcttttgaaaagttgaaatgtgtaattgttttggaataaagagggtaacaataggaaaggcctgattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttg

SEQ ID NO: 377741 - DNA, 507 bp, Homo sapiens
gagctggggttaatgtagtctctgtggaagggagacctctgggatcaaaagccagcattgagaagaggcaaaaggccccatgcccacttgttgccaagaggttttagcctctgggcggcatatcctcttcatgactgacattgatgctttggtccccggtatacatggctgcccctactgggaagggcacattcttaagtcttcttggtgtgtctttcggcagcacctgttccgcgagcctgagaagaggccccccaccgtggtgtccaatacattcactgccctgatcctctcgccgttgcttctgctcttcgctctggtgagtggctgtaattagcgtgggcagcatgcgtctggcgccagacccagcagatgcattccttccaaaggaggctgtgttgtctggcctcagtaaagctccagaggggtccagcagctgtgacctgaattgatgctcaagacattttagaatgaccaaaagttcccactgtggaggagtggccaaat

SEQ ID NO: 377742 - DNA, 985 bp, Homo sapiens
ccaactaaggctagtacgaggcgggtgttaatcggccgagggagacaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccggtgacataccagcaagcagggcgatcaagcgaaagccacagaacttgcagtctcccggcgtatgaacgggggacaaccc

SEQ ID NO: 377743 - DNA, 506 bp, Homo sapiens
  misc_feature (22)..(22): n is a, c, g, or t
  misc_feature (31)..(32): n is a, c, g, or t
  misc_feature (491)..(491): n is a, c, g, or t
aatcacgtgatcctcgatggangaatggcgnnccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagcccataagttgtgtctttgtgtccttcccattgtgtcaatcccaaataaatcaaatctattgtcccgttnactgtctcgttcatc

SEQ ID NO: 377744 - DNA, 2401 bp, Homo sapiens
gggcttgcgccgaaactttctggtcaaccgaagtgtcttcacgactgtgtgtgccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377745 - DNA, 2850 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaaaaaaaaaaaaaaaaaaaaaaacaaaaaaaaaaaaacaaaacaacaaaaacaaaaaaaaaacaaaaaaaaaaaaaaaaaaaagaaaaacgtaggggagagcgcagcgcacggcgcgcggcgagagaagacagttgaacacacaccgcgccgtggggggcggcgccgcccgacaggagaggagcacacagcagccgcgaaaaaggcagcacgacgagggaaccacaagacgggcacaaccaacagagggcgagggtagcaacacacacaataaaaaacaccccgccggcggcgaccaaaacggagggcaaagaaacaaccaccagacgaagatcaacggagagaaaaagcgggggccccc

SEQ ID NO: 377746 - DNA, 2601 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaaaaaaacaaaaaaaaaaaaacaaaacaacaaaaacaaaaaaaaaacaaaaaaaaaaaaaaaaaaaagaaaaacgtaggggagagcgcagcgcacggcgcgcggcgagagaagacagttgaacacacaccgcgccgtggggggcggcgccgcccgacaggagaggagcacacagcagccgcgaaaaaggcagcacgacgagggaaccacaagacgggcacaaccaacagagggcgagggtagcaacacacacaataaaaaacaccccgccggcggcgaccaaaacggagggcaaagaaacaaccaccagacgaagatcaacggagagaaaaagcgggggccccc

SEQ ID NO: 377747 - DNA, 2531 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagaggatcgctgcagagcagagcagtagattggcaaaatataggacactacgaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377748 - DNA, 2387 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377749 - DNA, 2404 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagggtaaggccagacatgagccagggatctagagtagggttagaaatactcagctctgccggcctagctctttgaagggtaggtggcaaaatgatttgtgttcttaggggcaagtctgacaccctaatctagcccagtacagaagccagaagcactttgaagtcagaaaagagccttagtggtcagctttgaatgtattacaaccattgtaattgatgccccaatacaatagaatgagag

SEQ ID NO: 377750 - DNA, 2447 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcgatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377751 - DNA, 2387 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377752 - DNA, 2307 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377753 - DNA, 2053 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgcctttggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377754 - DNA, 1826 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagcaaggagcattttgtcccgacttcccattaaccaggaaagaactgcgccagggacaggtgggtgttatggtaggccggaggccaagacgaacaacgaaacgtttgtaccacacgtttcgaaccttgggagatacgcgtcttgcagagcaaacgatttgcagttttggaactctttgccgtcttgggagccttaaaatcttacacgtttactcatcggagtatggcacacttgagagagaacgca

SEQ ID NO: 377755 - DNA, 1546 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccggtgacataccagcaagcagggcgatcaagcgaaagccacagaacttgcagtctcccggcgtatgaacgggggacaaccc

SEQ ID NO: 377756 - DNA, 1606 bp, Homo sapiens
  misc_feature (1477)..(1477): n is a, c, g, or t
  misc_feature (1488)..(1489): n is a, c, g, or t
  misc_feature (1491)..(1491): n is a, c, g, or t
  misc_feature (1493)..(1493): n is a, c, g, or t
  misc_feature (1499)..(1499): n is a, c, g, or t
  misc_feature (1506)..(1506): n is a, c, g, or t
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccggtgaataccngcaagcagggnntntnggaagnccagaantgccgtttcacgggagttaccggggggccccccacaatgcgcctctccaaagcgctggttttctcgcacaaagcttcggggtcccaaaagtgcctaccca

SEQ ID NO: 377757 - DNA, 1259 bp, Homo sapiens
  misc_feature (17)..(17): n is a, c, g, or t
  misc_feature (21)..(21): n is a, c, g, or t
  misc_feature (38)..(38): n is a, c, g, or t
cgagctcgataccctanctgngaaagacatccttaccnctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377758 - DNA, 1237 bp, Homo sapiens
ccaactaaggctagtacgaggcgggtgttaatcggccgagggagagcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagctggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 377759 - DNA, 1214 bp, Homo sapiens
cccgcggggagtggaggccgcgggctctgagcggcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacagccaaaagccgcactgcctgcgcccctggaacctgggtccggccttcctcagcccctggcccctccaaggtacctataagggacaagagaaggcctgcccagcatagcacaaacaaggaaataaataggtgttggcaggagccatgcttggggcaccgctccctgcttccttctttctagttttgggaaccaacagcacagaaaagcagtcagccccagggtggtcccttccatgtctgtgaccccagggctgctgctcaccaaagacagggcacggggtagggtgtttattcatccctccccggccccacttggtccatctgggccctatattcatcagttattgtccacagcctatacttttctccttttgacctcccttggtcaggcatggggtaagaagaaataatacaa

SEQ ID NO: 377760 - DNA, 1214 bp, Homo sapiens
  misc_feature (11)..(11): n is a, c, g, or t
aattcggcacnaggggaggccgcggctctgagcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacagccaaaagccgcactgcctgcgcccctggaacctgggtccggccttcctcagcccctggcccctccaaggtacctataagggacaagagaaggcctgcccagcatagcacaaacaaggaaataaataggtgttggcaggagccatgcttggggcaccgctccctgcttccttctttctagttttgggaaccaacagcacagaaaagcagtcagccccagggtggtcccttccatgtctgtgaccccagggctgctgctcaccaaagacagggcacggggtagggtgtttattcatccctccccggccccacttggtccatctgggccctatattcatcagttattgtccacagcctatacttttctccttttgacctcccttggtcaggcatggggtaagaagaaataatacaa

SEQ ID NO: 377761 - DNA, 1283 bp, Homo sapiens
gcgggaacaccggcgccgggattcggatgggggcgggtgggggacgctgcagctggggccatttgaggggagcccatggggcctgaaaggcatctgtcaggcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacagccaaaagccgcactgcctgcgcccctggaacctgggtccggccttcctcagcccctggcccctccaaggtacctataagggacaagagaaggcctgcccagcatagcacaaacaaggaaataaataggtgttggcaggagccatgcttggggcaccgctccctgcttccttctttctagttttgggaaccaacagcacagaaaagcagtcagccccagggtggtcccttccatgtctgtgaccccagggctgctgctcaccaaagacagggcacggggtagggtgtttattcatccctccccggccccacttggtccatctgggccctatattcatcagttattgtccacagcctatacttttctccttttgacctcccttggtcaggcatggggtaagaagaaataatacaa

SEQ ID NO: 377762 - DNA, 801 bp, Homo sapiens
cccgcggggagtggaggccgcgggctctgagcggcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacag

SEQ ID NO: 377763 - DNA, 842 bp, Homo sapiens
cccgcggggagtggaggccgcgggctctgagcggcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacagaaaaaaaaaacaaaagggggggccgccaaaaagattcctgg

SEQ ID NO: 377764 - DNA, 448 bp, Homo sapiens
  misc_feature (11)..(11): n is a, c, g, or t
aattcggcacnaggggaggccgcggctctgagcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagtttatagggcatctcggcccgtccggacccggcccg

SEQ ID NO: 377765 - DNA, 870 bp, Homo sapiens
gcgggaacaccggcgccgggattcggatgggggcgggtgggggacgctgcagctggggccatttgaggggagcccatggggcctgaaaggcatctgtcaggcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacag

SEQ ID NO: 377766 - DNA, 1260 bp, Homo sapiens
gactacaaggagatgatgagaggatgaagatgggcctggtttcatccgatccctgtcctaccgcctccctgttcttgcagcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacagccaaaagccgcactgcctgcgcccctggaacctgggtccggccttcctcagcccctggcccctccaaggtacctataagggacaagagaaggcctgcccagcatagcacaaacaaggaaataaataggtgttggcaggagccatgcttggggcaccgctccctgcttccttctttctagttttgggaaccaacagcacagaaaagcagtcagccccagggtggtcccttccatgtctgtgaccccagggctgctgctcaccaaagacagggcacggggtagggtgtttattcatccctccccggccccacttggtccatctgggccctatattcatcagttattgtccacagcctatacttttctccttttgacctcccttggtcaggcatggggtaagaagaaataatacaa

SEQ ID NO: 377767 - DNA, 999 bp, Homo sapiens
  misc_feature (20)..(20): n is a, c, g, or t
gctcggtaccctgtattggnggtgctctctaatggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagaacatgtagagctggtgaaaaggacaatggctggagtaagcctgcctgcgccaggggttcctgcctgggctcgggagatatcggatgcccagtgggaagatgtggtacagaaagccctccaagcccggcaggcatcccctgcctggaagtgaccacagtgagagctgccttatattcctacattccaggccagaaccagcacaggactgaacacatccctggttgtaatgtccatttccatcttccccgtctccctttccacatcaaggcacatcagacttctcagagacccactttattcagttctgtacatatggggacatcggtccaagcccaacccaccttagcatgtatcactctgtggagaataaagcaccctatgtacacagccaaaagccgcactgcctgcgcccctggaacctgggtccggccttcctcagcccctggcccctccaaggtacctataagggacaagagaaggcctgcccagcatagcacaaacaaggaaataaataggtgttggcaggagccatgcttggggcaccgctccctgcttccttctttctagttttgggaaccaacagcacagaaaagcagtcagccccagggtggtcccttccatgtctgtgaccccagggctgctgctcaccaaagacagggcacggggtagggtgtttattcatccctccccggccccacttggtccatctgggccctatattcatcagttattgtccacagcctatacttttctccttttgacctcccttggtcaggcatggggtaagaagaaataatacaa

SEQ ID NO: 377768 - DNA, 511 bp, Homo sapiens
tgagggaggaggtgctattgagatttagtgggcaagggagaaatctgcaaatgtcccacaatgaaggacacagtcctaaacaaatttcaaacactccactagaaatttatgtaggtaaaaatttttatagttacctgagccttggtcctaaactccatgttacatatttttttaaaaggatattttgcatggttttaaaatatactgaattttccaggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattgtcttaaaaaatta

SEQ ID NO: 377769 - DNA, 2581 bp, Homo sapiens
gtagggagcccgagctcgttctgggccggctccgagatactaatgcgcagcgcagtatcagctactcagtctcgaataatcgcaggcgcttctagcatgtctggacgttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaa

SEQ ID NO: 377770 - DNA, 2459 bp, Homo sapiens
aaatggccatgaaagagtaccacggaaactcaaatgcaccttcacatctcccaagactccagagcatgagggccgttactatgaatgtgatgtccttcctttcatggaaatggggtctgtggcccataagttttaccttttaaacatccggctgcctgtgaatgagaagaagaaaatcaatgtgggaattggggagataaaagatatccggttggtggggatccaccaaaatggaggcttcaccaaggtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaa

SEQ ID NO: 377771 - DNA, 3825 bp, Homo sapiens
atgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaaaaaaaaaaaaaaaaaaacaaaaaaaaaaaaaaaaaaaaaaaaaaaaaaaaaaaaaaaaaaaaaaaaaacaacaaaaacaaaaaaaacagcggcggccgcccgcgatccacacacacctccgaacgaggcaccagatcaccacacccccacaccgcactacctgttgaacaacgaagcaccgaccgacaagcgaggccccgctcaagtcaccacacggccgaccgtcgcaccgtaactcaccaccaaacgcgcagtcgcaaccaccacaccacacgaacagctacagccagcaagcgaacacaccccccacaacggcggacgcaccagaatgcacaccaacaaacacaacagcacgaaacagacaacaaccgagccaacaagacacacacacaagacaacagagcagacaagcatagagaggctagatcacaaacacacaaagcacagcgcgacgtcagctggcgacacagagcacacaacccacgccacccaccaaccatcgaccagacagaaacacataacaaaccaaccgagcacgaacaacaacaaacaacaagaccgccgcaccggcacacgacccacacgcaagcacgcacacatcagcacaggaacgcagaacagcaccgaacgcaagaacccaagcacccggcagaccgcaaccgacggcgcgcagacacacacacagagactcggcagctagcacgcacgacacccagcgccgcacacaaggagcaacgaacagcgcaccgaagcacccgcatcgcaccacaccgacgccacacagccgacgaccgcgcaccaacgcgccacgaagcgcacgatgcacgaaccagcggtcagcagagacaaacaaagcaagcagacgcgcgaaaagaagcagcgacgaggaggccacacgcacgcgacacgtacgcagcacgaccgacaccgtaaacgacgcgacgctgcgagcgacaagcagaacaccgcagcacgcgcgacaccaaggcaggcacacgccagcaggagagcagcaaacacagagaaacatacagaagcgacaacacagacagacaagcgcgccgacagccgagagagcctccgcagcacaagcaacaaacgacacacacagcacacgaccccagaagagagcgagcgagagcccagcacgacgaagccacgacacgaacgatcaaaccgagccagcgatg

SEQ ID NO: 377772 - DNA, 2048 bp, Homo sapiens
accttttaatgggagaagtcatcaagctgggttagggctgtgctcccagggctggcttcggaggcaggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaa

SEQ ID NO: 377773 - DNA, 1763 bp, Homo sapiens
atgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaacttcttgcttaaaatgcgttttattttgataagatacttcaaatagcctccaaaagtgtagatccaatcatttaaataaacctgtatgtatatgcatatgtgtacatgcatatcccctcctgctaaaactcatacacatgcgtgcagattattttccaggttgaacctagaggtggggagttgatgggggaaataggtttctgaaaaactgatatactttatcatcaaatcaaagtgtttggggataatacctattcctggagaaagagtgacattttctgtcctgtgtggttagcctccctaggctggcaagggatgctcatatgcgtgacaacaaaggtggg

SEQ ID NO: 377774 - DNA, 1419 bp, Homo sapiens
atgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaa

SEQ ID NO: 377775 - DNA, 1571 bp, Homo sapiens
gggcaaggtaaggaccactgactgtgcctgacagaaagctagagaaccttcagttgaccttaatttacaccgaaatgattcagattaaaagatggagtcttacatggcccttcatgtttcccacatgtagaagagacttggttttcatgttggttggttcctttattggtgttatgtttcttctgtttcttctctgtttcaattgaatatcaccatcctttctccgcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaacttcttgcttaaaatgcgttttattttgataagatacttcaaatagcctccaaaagtgtagatccaatcatttaaataaacctgtatgtatatgcatatgtgtacatgcatatcccctcctgctaaaactcatacacatgcgtgcagattattttccaggttgaacctagaggtggggagttgatgggggaaataggtttctgaaaaactgatatactttatcatcaaatcaaagtgtttggggataatacctattcctggagaaagagtgacattttctgtcctgtgtggttagcctccctaggctggcaagggatgctcatatgcgtgacaacaaaggtggg

SEQ ID NO: 377776 - DNA, 699 bp, Homo sapiens
gtagggagcccgagctcgttctgggccggctccgagatactaatgcgcagcgcagtatcagctactcagtctcgaataatcgcaggcgcttctagcatgtctggacgttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagttaagtgtactctcctctcatccctttcttccctttgagcattgccctctttgggttctttttgagccaattctaataaaagtaaaaatggtaatagt

SEQ ID NO: 377777 - DNA, 676 bp, Homo sapiens
gtttgaaaatctgccttccagatgaataaagtggctgtcctgatattttctcaccatcagagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggtaagagccgccgggagggcagacgtctgtaccagctgctctgtgcaggctgccaagctgacacctgcccccctttgcctctagtcagcagtgggtgagccagaataaactagtagttacaagtgggaactctggaggcagaccctctggttcacattcctgcttcaccacctgctgaccagctgagtggctttaggcaaatgacattatcactctgaatctcgggtccctcatctataaaatgggatgtaaagacctactgcatggggttttcatgagaattaaatgacagaatgtgagtaacttaagataaacacacacattctaatgattagtattatttcttgcccttgagcttgagtttcttgtctgctggcttctgccctgcttgtcctgtccccaggaatacaggttaaccatcaaagaatgtgggcctggctctttcca

SEQ ID NO: 377778 - DNA, 2635 bp, Homo sapiens
atgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaa

SEQ ID NO: 377779 - DNA, 2670 bp, Homo sapiens
atgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgcatacccataaatgagactattccaaacataaactctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaa

SEQ ID NO: 377780 - DNA, 2979 bp, Homo sapiens
atgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtggattttaaaaaatgtttgctaaactacccaagtaagatttactgtattaaatggccttcgggtctgaaaagcttttttaacttcttgcttaaaatgcgttttattttgataagatacttcaaatagcctccaaaagtgtagatccaatcatttaaataaacctgtatgtatatgcatatgtgtacatgcatatcccctcctgctaaaactcatacacatgcgtgcagattattttccaggttgaacctagaggtggggagttgatgggggaaataggtttctgaaaaactgatatactttatcatcaaatcaaagtgtttggggataatacctattcctggagaaagagtgacattttctgtcctgtgtggttagcctccctaggctggcaagggatgctcatatgcgtgacaacaaaggtggg

SEQ ID NO: 377781 - DNA, 2085 bp, Homo sapiens
atgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattgtcttaaaaaatta

SEQ ID NO: 377782 - DNA, 1719 bp, Homo sapiens
atgtgatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggtaagagccgccgggagggcagacgtctgtaccagctgctctgtgcaggctgccaagctgacacctgcccccctttgcctctagtcagcagtgggtgagccagaataaactagtagttacaagtgggaactctggaggcagaccctctggttcacattcctgcttcaccacctgctgaccagctgagtggctttaggcaaatgacattatcactctgaatctcgggtccctcatctataaaatgggatgtaaagacctactgcatggggttttcatgagaattaaatgacagaatgtgagtaacttaagataaacacacacattctaatgattagtattatttcttgcccttgagcttgagtttcttgtctgctggcttctgccctgcttgtcctgtccccaggaatacaggttaaccatcaaagaatgtgggcctggctctttccagctggcaatgtgtccaggtggccta

SEQ ID NO: 377783 - DNA, 454 bp, Homo sapiens
gtgacagaaaagggataattaggaaagcttcatgctaaattaaattcagtcttaaaaaattagcaggatgattttttaaatggagctgtcggtgaatgcactgtgtgagctagggtgcagcctgagagagagcagggcacgctgaggaccggctcggctgccgtgacacgagtgggtggtgtcttgggggtctctggggctggaccagatgagtgttgtcctcctgagtatctgctgtggaagctttgtgcttcctctcccttgtcccagtgtcttgctttgttctttgtttcttccgctagactgtcagctttgggaggaagcaggccgcatctgtcttgtccccagtgttgagcgcagtgtgtgctgcagcatggaagttgttccctaaatacccacagtgagatgaggctcccattacaaacatgtttttgaagctgcacttcgcagttgt

SEQ ID NO: 377784 - DNA, 725 bp, Homo sapiens
gtccgcctacttgtatcttcctcccaccgtgcacaaacacgctggaagctaaacggcttaaatatttaaatggcatgtgtgtgaaagcacttctactttgtgacagggccatgttgcacattagctctcaatgctatttgtgtgaacccgcttcatactttttaaagacaaaaatgctctattcatcattttattgacatttcatatttgcaggttttattcgcctgcgaggttaagacatttgaaacacaaatcctgacaaacgcacagaccagcaactcgaggaactcagacgctttggctctcggtgccacctttaaatgctaaaccaccggtaggtagtcgctaaatgggaaagtcgtgttctcccggttttcaggtggggaaaagctgaggctcccaggagtctagaactcctctcatattgcctttctccctggatcaactgggaatgatgataacagcagactgccccccacgcgtgataaggaaaaaaccttgtaattataataacttttggagctacctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagac

SEQ ID NO: 377785 - DNA, 888 bp, Homo sapiens
gccaggaaaccgagaacggaatgccaatactgcttaggcttagagtttgaaaggcatctgatttcactgccatgtctttgaacagcagtgcacagtgcagtcttcttcgtggctgaacagccactcgatgtcttttgattggagagtttaatcaaacagaaggagtcttccattgtggccaccacagctgggaatgagctaaggtcttgctatgttgcctagactggttttgaactcctgggctgaagcaatcctcccacttcggcctctcaaagtgctgggatatcagacatgagccacctgccatgcttggcctataatcatgaaaagatcaaccccaagaaagaaaaggaaacatggaaggacctggactggagtcacgccagtacaaggaggatactggcaaagatgaggctagtcaagtggagcagtgggagtgaagatggaataaagaaatccataactggttgtgattaagtagttgtaaacaccaactgcactcagaccaacccatatatatatttttaattgtaagcatagtatatataaaacttcaattcctgcttttttttacctaacattatatcatatgcattttccatactgtttcacaattccttgtattcgtaattgtttaatcctgcaaaataatgcttcgaatgaacatatgatcatttccttaagtattcccctactattagaagtgaagtttcttccagcatttttctctttgctgtgatgaatatttttaagtatagagatttttcagtttggttatgagtttttgaaaatctactttaccaaaaacaaagaaaacccatgtctttctttagtacctttgccaagatattacttttacttgacattcaacaagtataggatgaaagt

SEQ ID NO: 377786 - DNA, 418 bp, Homo sapiens
cacaaagcttgactatctggccctatacagaagaagtttgctgatctctgacttagctgcctaggaatagccaggcaaccagctgctactttgagcacccggctaaaataagcagagacaactggaaggcttgatgtgaaaaagagctgttgaagtgtacacaagcaagctgactgccttatgactaatacttgacagaacccagcaagaggatatgagattgcagatggatgacctcaatcctgaacagaaaggcgtgcatgataatggagagaaaaaagccaatggggaaaaaaaacccaccactatttttttaatagcctaacacacacacaaaaaactggttttcctttttctgtaatgtgtctgtagagctggctattctgattaaagttgcccttgaaaaagcaaaacttaa

SEQ ID NO: 377787 - DNA, 680 bp, Homo sapiens
gccaggaaaccgagaacggaatgccaatactgcttaggcttagagtttgaaaggcatctgatttcactgccatgtctttgaacagcagtgcacagtgcagtcttcttcgtggctgaacagccactcgatgtcttttgattggagagtttaatcaaacagaaggagtcttccattgtggccaccacagctgggaatgagctaaggtcttgctatgttgcctagactggttttgaactcctgggctgaagcaatcctcccacttcggcctctcaaagtgctgggatatcagacatgagccacctgccatgcttggcctatctgcctaggaatagccaggcaaccagctgctactttgagcacccggctaaaataagcagagacaactggaaggcttgatgtgaaaaagagctgttgaagtgtacacaagcaagctgactgccttatgactaatacttgacagaacccagcaagaggatatgagattgcagatggatgacctcaatcctgaacagaaaggcgtgcatgataatggagagaaaaaagccaatggggaaaaaaaacccaccactatttttttaatagcctaacacacacacaaaaaactggttttcctttttctgtaatgtgtctgtagagctggctattctgattaaagttgcccttgaaaaagcaaaacttaa

SEQ ID NO: 377788 - DNA, 468 bp, Homo sapiens
cagattgcagttaggaaacagaccctggtcagaaggtcttagacaaaaatcttagcatcaagctcagattattccttcctgcttcatttgtgttctcctcacaatgctttcagctgcctaggaatagccaggcaaccagctgctactttgagcacccggctaaaataagcagagacaactggaaggcttgatgtgaaaaagagctgttgaagtgtacacaagcaagctgactgccttatgactaatacttgacagaacccagcaagaggatatgagattgcagatggatgacctcaatcctgaacagaaaggcgtgcatgataatggagagaaaaaagccaatggggaaaaaaaacccaccactatttttttaatagcctaacacacacacaaaaaactggttttcctttttctgtaatgtgtctgtagagctggctattctgattaaagttgcccttgaaaaagcaa

SEQ ID NO: 377789 - DNA, 6106 bp, Homo sapiens
ccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttctttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcagggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggacctgagcctgtatggccctgtagccctgggcagagctgggcctgtcgtgtgttcctgcctggcaggtgcaggtgctggccatctgcaggtggaaggaggtgggaatcttggattttttgtttttttttgttttttttttttgagatgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcgtgagccagtgcacccggcggaatcttggaatttttatagacagcacctcagtttctgactccagccgcacacctcctgcctctaccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgccgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcg

SEQ ID NO: 377790 - DNA, 2761 bp, Homo sapiens
ccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttctttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatg

SEQ ID NO: 377791 - DNA, 314 bp, Homo sapiens
caccccgtatctcccctttccgtgaggttaaaggggtgtgttggccctccctacccaaaatggggctctaaagagctttccttcgatttcctggtccagggatcggggacatccacgtgccacccacccatccttagtgcctcctaagccatgtctggagcagcggccggcgtgtgaccactttgtgtgctctgagcaccaggtgcagacatgcctcctgtggggcctctgatctccaagggaggtttccgggagcaaagtgaagtgaagggattggaaactcaggccactcagccagcaggggctgctgaaat

SEQ ID NO: 377792 - DNA, 5627 bp, Homo sapiens
ccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttctttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcagggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggacctgagcctgtatggccctgtagccctgggcagagctgggcctgtcgtgtgttcctgcctggcaggtgcaggtgctggccatctgcaggtggaaggaggtgggaatcttggattttttgtttttttttgttttttttttttgagatgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcgtgagccagtgcacccggcggaatcttggaatttttatagacagcacctcagtttctgactccagccgcacacctcctgcctctaccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctgccccttatgaaaccatcagatctcatgaggattcactcactatcacgagaacagcatgagggtaaccacctccatgattcaatgacctcccaccaggtccctcccatgaca

SEQ ID NO: 377793 - DNA, 1396 bp, Homo sapiens
ccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtggggacacttccttaaccaaaaaggaagggttaatgtcttttgggtcttatgtaccttgctcacaccaatagccttcgtccctcagtattacattgatcaatccgtcccccgcaagcttcaaactttggttattgaaaactcttggttttagtgtatttaactaaattctttta

SEQ ID NO: 377794 - DNA, 6277 bp, Homo sapiens
  misc_feature (6277)..(6277): n is a, c, g, or t
ccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttctttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcagggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggacctgagcctgtatggccctgtagccctgggcagagctgggcctgtcgtgtgttcctgcctggcaggtgcaggtgctggccatctgcaggtggaaggaggtgggaatcttggattttttgtttttttttgttttttttttttgagatgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcgtgagccagtgcacccggcggaatcttggaatttttatagacagcacctcagtttctgactccagccgcacacctcctgcctctaccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgccgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcgaaaaaaaaaaacaaaagggggcggtaaataccccggggccaacataccgacccctttggaaggggcaaagggggaaaaaggccggcgggcaaggcggggacagccgggttggagacccttgggggatgcaccacaaccgataatattgcacatcgtggtgtaaatacaagn

SEQ ID NO: 377795 - DNA, 2992 bp, Homo sapiens
ccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttctttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttg

SEQ ID NO: 377796 - DNA, 165 bp, Homo sapiens
taaagtcttagaggttaggttgagagaaggtggtggtcctggttcttacagtacagtattaagtttgtcaggcatctcatgtttgagaacttgattcctcagttatatttactaaaacaactccaaaagcaagaaggcaggaagtggtcagagctgtgtcccttt

SEQ ID NO: 377797 - DNA, 480 bp, Homo sapiens
tagagatggggtttcaccatgttggccaggctggtgttgaactcctgaccttaggtgatccacccgcctcggcctcccaaagtgtttggattacaggcgtgagccactgcgcccagtgctaataattttttaaaaaaatatctgtttgttagctggatgtggtgttcttgcacctgtagtcccagtcccaggtatttgggaggccgaggtaggagcatcacttgagcccaggagtgagttaatgcccagcctgcacaatatagtgagacctctgtctccaaaaaaaaaaaaaaaaaaaaaaaaaagcggttcaaaccaagatccagataaggttcataacttgtaattagttgagtagctcttgaagtcttttttagtctatagcttttccactcattttttcctgtactatttattttttgaagaaagcatgttcgttattaagagttttccagtcttggccgggcacagtgggtcaca

SEQ ID NO: 377798 - DNA, 572 bp, Homo sapiens
actgtaaagaatttaaaagtttattaaattattctagagacagaagatgtttcaagtactcaaaagtttatatttcaattggtcaattttatttaggtgtttattggtaaattacatataaaccattttatagctagaaaataggttcttctccccatgagtattctctaatgacataggtatggaaatgaacatgtatttaaatccatcgtacagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggtgagctggcattctgccctgtttcaacccaggagtgcatttgctggattatttccttgtagtggtgggatactttttatgtcagttatattttctatggaaactggaggaaaaacagttcattttggacattaaaatactttgaacacgtccatgg

SEQ ID NO: 377799 - DNA, 3986 bp, Homo sapiens
ggcttaagcagtggtaacaacgcagagtacgcggggtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaataccc

SEQ ID NO: 377800 - DNA, 3940 bp, Homo sapiens
ggcttaagcagtggtaacaacgcagagtacgcggggtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacaccaatggcactgattttggtacacatcagtgccattggtgtgtgtgtacgtaactatatacatatgtgtgtgtgtgtacctacataatgtgtcatacccgtaa

SEQ ID NO: 377801 - DNA, 2939 bp, Homo sapiens
actgtaaagaatttaaaagtttattaaattattctagagacagaagatgtttcaagtactcaaaagtttatatttcaattggtcaattttatttaggtgtttattggtaaattacatataaaccattttatagctagaaaataggttcttctccccatgagtattctctaatgacataggtatggaaatgaacatgtatttaaatccatcgtacagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377802 - DNA, 2468 bp, Homo sapiens
ctggtacaggtcccgaatcctttggatcagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377803 - DNA, 2822 bp, Homo sapiens
taaactaattgtggacagtggaaaataaccagtctcatcattagcgtttgaagtttgaaaatttggttgtcggtaaatcaaattctgactaaagatgttaaaggatgttacaaggtatctgctagtggaagagggaggcatttttcattagaaaaatacattaccaaccagacaaaataaaattattaattgtttcacagactgcttaaagactgcattaaataaaaatgatcagaactttaaatgttttatttatagaagactatttatttatttttttactatcctgcttttttaggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377804 - DNA, 2579 bp, Homo sapiens
gggagtgaaagggtgctgtagaccagacaggggaggtggtgagaaggtacaaaaacaacgctctttcagaaagccagtattcttataaaagtattggtcttttatttaatatactagtaattataaaacgtttataatcacaacatgaagaaaaaaagttcatagaccgtaacttgtgtaatttcagcttgtacataattgactaagtaaacttaccttgtcatgtgtttgaagctgtggcttgccaggatcagtttattaggacatttgttttttattttatctaacaaattaccctctagtgtgctcctctttagtttttttctgagaaatttcccatttatgtctttttaaatttaaccagagcaaactggactttaatcacaaaacttccaagaggtcaaaaccatgtgaaaagttgattgctttggccttttcatgagttagcataccagctgtaggtttccatgtcacattcctaccaagtctctgatctgttgtatgattttccctttgtcttcatattcctccaaaagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377805 - DNA, 3857 bp, Homo sapiens
ggcttaagcagtggtaacaacgcagagtacgcggggtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaagagccagtttgccatgtgctttttctaagtgcccatgctggaaaaaataatcaacaacaacctatttagctgttccccaaccttttcctccgaccccctaacaaaccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatattcttcttcgaaacacacttatcccatcttgggtatcatcacccgatgaggcaaacagccagaacgcctgaacgcaggcaccatacttcctattctacacctagtatgctccccttccctatcatcgcactaatttacactcacaaaaccctaggttcactaaaacattctaatactccatctcatgccaagaaatattaatcttagcaaaaacttatatgactagcttaacaagctttatagtaagatactccttagggaccactaataatcctaagccagtgtagccccctgcggtcataatatgcggcgaactataaaaagggggggataagctcacaattttaccccgtgtaaaataataccctttttttcataggaaaataaggcaccgcgtggaacaactctgtttttacaaccgtggtaacccacgcggttagttaatatattactgaccatctattttttttcttt

SEQ ID NO: 377806 - DNA, 1732 bp, Homo sapiens
tacagtttgtaaaaaaaactgtagtccaactaaagttctctgtctcctcacgcagcagaggcattatctccataaggtgtgtgtggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377807 - DNA, 2433 bp, Homo sapiens
tagaactagtcctcgactcgtagccgcgggctgcgcggggagtcgccgctgccgccgccgccgccgccgccgccgccgccgccaagcgcccgtcggacggggaggaggagcaggagctggaggaggagccgccgccgccagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacatatacatacatacagtggaatattattcagcttccaaaaggaagaaaatgtctatatagcatatagacatatgctataacatggatgcaccttgagtacaacctgccggtgg

SEQ ID NO: 377808 - DNA, 1762 bp, Homo sapiens
tagaactagtcctcgactcgtagccgcgggctgcgcggggagtcgccgctgccgccgccgccgccgccgccgccgccgccgccaagcgcccgtcggacggggaggaggagcaggagctggaggaggagccgccgccgccagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggtgagctggcattctgccctgtttcaacccaggagtgcatttgctggattatttccttgtagtggtgggatactttttatgtcagttatattttctatggaaactggaggaaaaacagttcattttggacattaaaatactttgaacacgtccatgg

SEQ ID NO: 377809 - DNA, 4357 bp, Homo sapiens
ggcttaagcagtggtaacaacgcagagtacgcggggtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377810 - DNA, 4372 bp, Homo sapiens
ggcttaagcagtggtaacaacgcagagtacgcggggtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcgcacacacacacaccacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377811 - DNA, 4129 bp, Homo sapiens
tagaactagtcctcgactcgtagccgcgggctgcgcggggagtcgccgctgccgccgccgccgccgccgccgccgccgccgccaagcgcccgtcggacggggaggaggagcaggagctggaggaggagccgccgccgccagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgttttgaagagggttttggttttggttattgtgtcttttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377812 - DNA, 3167 bp, Homo sapiens
ggcttaagcagtggtaacaacgcagagtacgcggggtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctcctttcaccttaaaagatccatctaagtctcagatctggaaacgttttgtaccgattatccacagcaaaacaaaaataagcttttattttattaacaatttcgttcctcttgtgcccaatcaaatcttttaggaacaaactgcaagaaaagctaagaatgttttagagtgaactaaatacagacattgcttacttgtt

SEQ ID NO: 377813 - DNA, 3301 bp, Homo sapiens
tagaactagtcctcgactcgtagccgcgggctgcgcggggagtcgccgctgccgccgccgccgccgccgccgccgccgccgccaagcgcccgtcggacggggaggaggagcaggagctggaggaggagccgccgccgccagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctatattctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacaatggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacattggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaacaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagcca

SEQ ID NO: 377814 - DNA, 664 bp, Homo sapiens
ctagatctttttttgtaatctttttgggaatttcctcctttatactctcatctttaaaatattttattatgaaaataagctcaatatattacagaaatgcataagaaagcacaaaccacctgtcatgtcacaacatggacagtctaggtaactgtgaacttcttgtttcattttattttcatttatctttttacaatttttttttttacattggcaacattttcaaaataggcatccagaactgggcgtggtggcatatacctgtagtcctagctactcagaaggctgaggcagaaggattgcttgagtacaggagttcaagtttagcctgggcaacatggtaagactccgtcttgtaaaaataggcatccagggctgggcgtggtggctcacgcctgtcattccagcactttgggagactgaagtgggcagatcacctgagggcaggagttcgagaccagcctgaccaacatagtaaaactccgtctctactacaaatacaaaattagccaggcatggtggcacatgcctgtaatcccagctatcgggaggctgaggcaggagaattgcttgaaccccgtggggcggaggttgcagtaagccgagattgtgccattgcattccagcctgggcaacaagagtgaaactccgtctcaaaaaaaaa

SEQ ID NO: 377815 - DNA, 1868 bp, Homo sapiens
gagggaaacggcaaactgcaccccagcccctcctggcctggcaccccttccaaatggtgcaatgagtgggtcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggcgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaagggccacctcctgcccagcccctggcacagcgtctctgctccatggtctgcttcagtctgcttgccctgagcttcaacatcctgctgctggtggtcatctgtgtgactgggtcccaaagtgagggtcacagaggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaaaaaaaaaaaaaaaaaaaaaataaaaaaaaaaaaaaaaaaaaaaaaaaaaaacaaaaaaaaaaaaaaaataaatacacatcatacccaccacaaactactaaactacaaactctaaatctctcatacaaaaaaaaaaaacattgggccccctttcgcccaaaggtttttaaaactggggaacttttatttgccgcccgcaatatcggctttcttgggcaaataccccctatgggggggctttaaaaaaaacgtggcccgcgcttaaaacagtgtggtgtgggaaaaccctcgggggttcccccaattaaacgccttgggaacaaaccccctttttcccgcggggcga

SEQ ID NO: 377816 - DNA, 1322 bp, Homo sapiens
ggctgcaggaattcggcactaggtcatctgtgtgactgggtcccaaagtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaaaaaaaaaaaaaaaaaaaaaataaaaaaaaaaaaaaaaaaaaaaaaaaaaaacaaaaaaaaaaaaaaaataaatacacatcatacccaccacaaactactaaactacaaactctaaatctctcatacaaaaaaaaaaaacattgggccccctttcgcccaaaggtttttaaaactggggaacttttatttgccgcccgcaatatcggctttcttgggcaaataccccctatgggggggctttaaaaaaaacgtggcccgcgcttaaaacagtgtggtgtgggaaaaccctcgggggttcccccaattaaacgccttgggaacaaaccccctttttcccgcggggcga

SEQ ID NO: 377817 - DNA, 884 bp, Homo sapiens
gagggaaacggcaaactgcaccccagcccctcctggcctggcaccccttccaaatggtgcaatgagtgggtcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggcgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaaggcaagtgtgcagtttctgcggctttgctccccctctgtctcagctcatgattgctctgtccctttgaggtctctgccgcacccactctgtgaacagggactgaggagggcccgacacccccgcttgttccctcacctcaccttcctgtctaccccaggaccccaggaaaggcatgtgccagaggtgtggggagatctggaagataactgcctgcccttctcctcccaacccaagaacacatgtgccccgtatgtgcgtgtgcacgtatgtgcatatgaggaatgcagattcagctgggactctgctcgtgtgtgtgtgagtgaatgttgtgtgtgtgtatatgtgcgcgagagcgtgcatatgtgtgtgtgttatgtcgtgtatgtgagagggtatgttgtgtgtgagagtgtgttgtgtgtg

SEQ ID NO: 377818 - DNA, 1811 bp, Homo sapiens
gagggaaacggcaaactgcaccccagcccctcctggcctggcaccccttccaaatggtgcaatgagtgggtcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggcgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaagggccacctcctgcccagcccctggcacagcgtctctgctccatggtctgcttcagtctgcttgccctgagcttcaacatcctgctgctggtggtcatctgtgtgactgggtcccaaagtgagggtcacagaggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaaaaaaaaaaaaaaaaaaaaaataaaaaaaaaaaaaaaaaaaaaaaaaaaaaacaaaaaaaaaaaaaaaataaatacacatcatacccaccacaaactactaaactacaaactctaaatctctcatacaaaaaaaaaaaacattgggccccctttcgcccaaaggtttttaaaactggggaacttttatttgccgcccgcaatatcggctttcttgggcaaataccccctatgggggggctttaaaaaaaacgtggcccgcgcttaaaacagtgtggtgtgggaaaaccctcgggggttcccccaattaaacgccttgggaacaaaccccctttttcccgcggggcga

SEQ ID NO: 377819 - DNA, 1956 bp, Homo sapiens
gagggaaacggcaaactgcaccccagcccctcctggcctggcaccccttccaaatggtgcaatgagtgggtcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggcgtccgctctccacacctttcacagatcctacccaggccaccaccccgaacccctccgaccctgcgttccatcccaccatcaacctccacgtgaatctgcacctctgccccagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaagggccacctcctgcccagcccctggcacagcgtctctgctccatggtctgcttcagtctgcttgccctgagcttcaacatcctgctgctggtggtcatctgtgtgactgggtcccaaagtgagggtcacagaggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaaaaaaaaaaaaaaaaaaaaaataaaaaaaaaaaaaaaaaaaaaaaaaaaaaacaaaaaaaaaaaaaaaataaatacacatcatacccaccacaaactactaaactacaaactctaaatctctcatacaaaaaaaaaaaacattgggccccctttcgcccaaaggtttttaaaactggggaacttttatttgccgcccgcaatatcggctttcttgggcaaataccccctatgggggggctttaaaaaaaacgtggcccgcgcttaaaacagtgtggtgtgggaaaaccctcgggggttcccccaattaaacgccttgggaacaaaccccctttttcccgcggggcga

SEQ ID NO: 377820 - DNA, 1899 bp, Homo sapiens
gagggaaacggcaaactgcaccccagcccctcctggcctggcaccccttccaaatggtgcaatgagtgggtcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggcgtccgctctccacacctttcacagatcctacccaggccaccaccccgaacccctccgaccctgcgttccatcccaccatcaacctccacgtgaatctgcacctctgccccagccccagccctcagagcaacctcagcccagcccagcccagctccagctccagctccagcccgggccccatcatggccaaggactttcaagatatccagcagctgagctcggaggaaaatgaccatcctttccatcaagggccacctcctgcccagcccctggcacagcgtctctgctccatggtctgcttcagtctgcttgccctgagcttcaacatcctgctgctggtggtcatctgtgtgactgggtcccaaagtgagggtcacagaggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaaaaaaaaaaaaaaaaaaaaaataaaaaaaaaaaaaaaaaaaaaaaaaaaaaacaaaaaaaaaaaaaaaataaatacacatcatacccaccacaaactactaaactacaaactctaaatctctcatacaaaaaaaaaaaacattgggccccctttcgcccaaaggtttttaaaactggggaacttttatttgccgcccgcaatatcggctttcttgggcaaataccccctatgggggggctttaaaaaaaacgtggcccgcgcttaaaacagtgtggtgtgggaaaaccctcgggggttcccccaattaaacgccttgggaacaaaccccctttttcccgcggggcga

SEQ ID NO: 377821 - DNA, 789 bp, Homo sapiens
tctttgaagcacgtattgtcagaacacagttcctgccccatttccttgttgcatcatctacagatcttctggtcgcttcctttcctccactgatgactttagcacctgtcttcatccttgatacccctgcaggtcaatgcttccccatctttttcaggttgtatcacatatagaaaagaatcaaatatgtctagcaccccgaggtaaaccagaggggatctcatgatcttcacatgaaccttagtgtcttagacaaagggggcagtggtagttttgttctattttggtttgtttttgagacgggtgatagaaaagcatgcttttgtgctgacaggaaagatctaggagagagggagaaattgatgctgccagaaagaggggacagttacagaagcgaagaccttgagaaggagatgatgagacccaggatgcaacacagaaggcttggacttagataagggcatcaaggtccctcgacagtgcctggagggaagattcctggatatcacgtgagaaggtgaggtcggtctcatcagattccatctattttctcaatggaaaatgtgagaggaagtaaccagctgagaagagaaggaagtggtcttggaggtgtgaaaggagaggagatgcagtaaaatagttacgtctcaaagggaggaagccgattgcacgaacttaactggattttgggcaggtagagccttacaattacgcattagaatgaaccagcaaataccccttactagggaagaaaatgactttaataaggccctggcacgtgaaaaaaaa

SEQ ID NO: 377822 - DNA, 140 bp, Homo sapiens
ggttcgcgggcgggccgcccctccccgggctcctagggggaccctccagctggaggggcggtgaccgcgactgtcgtgggctggccccaggtggctagggttgggggtcagaggtcagaggttctgccctctggaatgtt

SEQ ID NO: 377823 - DNA, 2461 bp, Homo sapiens
cgcggtggcagctgcgggtcgcgggtcgcgggtcgcgagtcgccggtcgccggtcgcggcggagcctgggcgctgaggtaccggggcctggacgagggggccgcggtctggctagggagccgcgcgggctcatggcggttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactcggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctgggttctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcctggcctccaagagttctggacaggaggcagacactgcccagatgctcggtggagggacagtgatggcctttgactcatgaggcctagagaaaagtatcaaaggtctcaccatgtaagagtgatttccgatttctctcctttcagttgtgtgaaaaaacagctggcctgggttccattagcaaattaaatcatcttcaatcttaaattagagaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggagga

SEQ ID NO: 377824 - DNA, 2691 bp, Homo sapiens
cgcggtggcagctgcgggtcgcgggtcgcgggtcgcgagtcgccggtcgccggtcgcggcggagcctgggcgctgagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactcggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctgggttctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcctggcctccaagagttctggacaggaggcagacactgcccagatgctcggtggagggacagtgatggcctttgactcatgaggcctagagaaaagtatcaaaggtctcaccatgtaagagtgatttccgatttctctcctttcagttgtgtgaaaaaacagctggcctgggttccattagcaaattaaatcatcttcaatcttaaattagagaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggagga

SEQ ID NO: 377825 - DNA, 2751 bp, Homo sapiens
cgcggtggcagctgcgggtcgcgggtcgcgggtcgcgagtcgccggtcgccggtcgcggcggagcctgggcgctgaggtaccggggcctggacgagggggccgcggtctggctagggagccgcgcgggctcatggcgtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactcggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctgggttctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcctggcctccaagagttctggacaggaggcagacactgcccagatgctcggtggagggacagtgatggcctttgactcatgaggcctagagaaaagtatcaaaggtctcaccatgtaagagtgatttccgatttctctcctttcagttgtgtgaaaaaacagctggcctgggttccattagcaaattaaatcatcttcaatcttaaattagagaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggagga

SEQ ID NO: 377826 - DNA, 2333 bp, Homo sapiens
  misc_feature (2288)..(2288): n is a, c, g, or t
  misc_feature (2290)..(2290): n is a, c, g, or t
  misc_feature (2295)..(2295): n is a, c, g, or t
  misc_feature (2302)..(2302): n is a, c, g, or t
cgcggtggcagctgcgggtcgcgggtcgcgggtcgcgagtcgccggtcgccggtcgcggcggagcctgggcgctgaggtaccggggcctggacgagggggccgcggtctggctagggagccgcgcgggctcatggcggttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactcggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctgggttctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaattgcccagatgctcggtggagggacagtgatggcctttgactcatgaggcctagagaaaagtatcaaaggtctcaccatgtaagagtgatttccgatttctctcctttcagttgtgtgaaaaaacagctggcctgggttccattagcaaattaaatcatcttcaatcttaaattagagaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggaggaaaattgattccccctttttatttaatttttttttggagacagtctcactccttcccccaggcaggagaatcacttgaacctgggaggcggangntgcantgagccnagatcacaccactgggattcagccctgggac

SEQ ID NO: 377827 - DNA, 1323 bp, Homo sapiens
  misc_feature (15)..(15): n is a, c, g, or t
gcattccctgacganccacgcgtccgtggacgcgtgagagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctgggttctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcctggcctccaagagttctggacaggaggcagacactgcccagatgctcggtggagggacagtgatggcctttgactcatgaggcctagagaaaagtatcaaaggtctcaccatgtaagagtgatttccgatttctctcctttcagttgtgtgaaaaaacagctggcctgggttccattagcaaattaaatcatcttcaatcttaaattagagaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggagga

SEQ ID NO: 377828 - DNA, 390 bp, Homo sapiens
gtatgcttgcttttctcgctgctcttatttttctgaacctttcttggtggtagcttacttgacttttggtaaagttttaccttctctcgtttagaactgcatggtcttttgtatgctgtgtatctatataaccctgtttttctctaattatgttttcagcattcagagtgattaacaatggcaaagtaagtaggaaagtatttctagaattgctgcattttctcctagattgcaactgtttcactttgctaacactgtgctacagatttgtatggccttctctaggggtatataagctacttaatttaagaaatctctttctcctacaagtgtcttatctaacaaggtccaaatgtctgaaacatgttgtgtggggtgttgcggtctttc

SEQ ID NO: 377829 - DNA, 365 bp, Homo sapiens
ggttcgcgggcgggccgcccctccccgggctcctagggggaccctccagctggaggggcggtgaccgcgactgtcgtgggctggccccaggtggctagggttgggggtcagaggtcagaggttctgccctctggaatgttagggccccgcccgtggagccgtggagccctggggccgggccgctccccattttcctgtcagctcttgttgaggtgccccatcttttcgcagaagggacttggagggaagcgggcctgcgagctgctgccgccgcccctgagctcggacgcgaaggctggccccgtccccgggctgccgccgtggtcctgcaggtgaccctcaaccccccgaggaccgccggccgc

SEQ ID NO: 377830 - DNA, 517 bp, Homo sapiens
aaaagcatgcttttgtgctgacaggaaagatctaggagagagggagaaattgatgctgccagaaagaggggacagttacagaagcgaagaccttgagaaggagatgatgagacccaggatgcaacacagaaggcttggacttagataagggcatcaaggtccctcgacagtgcctggagggaagattcctggatatcacgtgagaaggtgaggtcggtctcatcagattccatctattttctcaatggaaaatgtgagaggaagtaaccagctgagaagagaaggaagtggtcttggaggtgtgaaaggagaggagatgcagtaaaatagttacgtctcaaagggaggaagccggcatgccaggaagctgcagctgcatctctgggcagtgttgagagccatttacaatttacggtcatgaggaatgaaaacagtccagaattagcccctttactcagtgaagtaaagatgatctttctaataaatggtactgggacaagttgagagccttgaaact

SEQ ID NO: 377831 - DNA, 759 bp, Homo sapiens
cgcggtggcagctgcgggtcgcgggtcgcgggtcgcgagtcgccggtcgccggtcgcggcggagcctgggcgctgaggttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggaaagatctaggagagagggagaaattgatgctgccagaaagaggggacagttacagaagcgaagaccttgagaaggagatgatgagacccaggatgcaacacagaaggcttggacttagataagggcatcaaggtccctcgacagtgcctggagggaagattcctggatatcacgtgagaagctgcgtttgctttggttagctagaaagcaggcccatcatgcatctgtaagaaagtgactggagtgtaggccctggcgtctaagccgagtaagatgc

SEQ ID NO: 377832 - DNA, 2673 bp, Homo sapiens
aacattcctttcagtgccatggtggtttcgcccaaagcgatttgttgcagtcacactttaaacagtttaagaaagatctgtttttcaaaactgatcttaaattgttcaaacctgtaaatctttaggaatatctgattactaaactatatattgaggttgagtgaaagccaaaaaaacaaaatttcagcctaaactaactttgtgtacagctgcagttttccagtcttcatcagattcgtcagtgaagtgggcttgaatcatcacccagaaagattaagagccactttttggaaagttatttttaaggagctccgcatattttatgatgtttatcttcgtgccttcctaggttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactcggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctgggttctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcctggcctccaagagttctggacaggaggcagacactgcccagatgctcggtggagggacagtgatggcctttgactcatgaggcctagagaaaagtatcaaaggtctcaccatgtaagagtgatttccgatttctctcctttcagttgtgtgaaaaaacagctggcctgggttccattagcaaattaaatcatcttcaatcttaaattagagaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggagga

SEQ ID NO: 377833 - DNA, 2883 bp, Homo sapiens
cgcggtggcagctgcgggtcgcgggtcgcgggtcgcgagtcgccggtcgccggtcgcggcggagcctgggcgctgagaagggacttggagggaagcgggcctgcgagctgctgccgccgcccctgagctcggacgcgaaggctggccccgtccccgggctgccgccgtggtcctgcagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaacacattttattttagacctaatggggctggagataccaggcagaatttaattccggatttctatgcattcagagtgattaacaatggcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactcggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctgggttctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcctggcctccaagagttctggacaggaggcagacactgcccagatgctcggtggagggacagtgatggcctttgactcatgaggcctagagaaaagtatcaaaggtctcaccatgtaagagtgatttccgatttctctcctttcagttgtgtgaaaaaacagctggcctgggttccattagcaaattaaatcatcttcaatcttaaattagagaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggagga

SEQ ID NO: 377834 - DNA, 304 bp, Homo sapiens
ggtgttgtaaggggctttttccaacttcatttccattaccaagagtcttgagtggctttattttcaacttgggttttttaagcgcttctcatgtcacctttgtttgtgtactgggcctgtctcaagtttccagagggagatgaaagacaagaaaagctaaatgactggttcttcagtgagtttcccagagtggcttcttctcattccagcactgcctaactctcaccatggctgacgccgtgggcaggcatccgcattcatggaaagccaggtcctagctggaagtgacacagggatcttcaga

SEQ ID NO: 377835 - DNA, 277 bp, Homo sapiens
ctgtagagatggggtctccctgtgttgcccaggctggtcttgaactcctaggctcaagcagtgctccaatcttgacctcatggtggcatgagccaccatacctggccttatttttttagagacagagcctcactctgtcatccaggctggagtgcagtatattttatttttattttatttttttaagtgacagagtctagctatctatatttatatttatataaggggtagaggaagtgtttgcaattaaccacaggtgttctttagctaaagatct

SEQ ID NO: 377836 - DNA, 717 bp, Homo sapiens
gacactgctaaacatgcagtgcttcgtggataggatgatgtggtcagtggaaaaagtgaccactactcagcctaagcatatgacctcagtaatgagcaaaccttttggttatctacccccagccctagaatttctctttctttgggaaatcacatgtacaaaaatcaactaaagatccagctgagccctgactcttctacatttaatttggggaccctaataatagaggccagtccagaagcagctacactggataggttgagactggattgcattagggtggggaatctgttcccactttttaacccttccaaataaaacactattgatctggcccttctcaatttatctttagtaagccaagcaggaagagcacttttatgtgtttctctggccaatactttctgccctgcacttgaatctttaaaaatattacttctttgtaaaaggtatacacaccttgattcattcttaatttggcaagtgacttacaatgttatccctgagtggaccatgcaaactatttaaataatcaaaatatgaaccaagaagtagctcggtggtagaaaagtttgcttctaaagtgaacatttgcaaatatcagtctttaggtcctgcagcccatttgctggtctgtaactgagtgattctgccatcctttggggaacacaataacatccagctgtatcagcattaatttgcctatatgcccaagat

SEQ ID NO: 377837 - DNA, 378 bp, Homo sapiens
tttttttttgagacacagtctcactctgtcgcccagaaaataactagaaattgctttaaaaattattttgattagaaattaaatatcataaaacttaacctttaaaaaaatcacaaatagacaatttgtaagatacattaaaaagtactatatacttctaagaaaaatttagctttaaaagcattgatcagaaaataagagaggtgaaaacaacagagctaagcatttcccttgggtatcagaagagaggaaacaaaaagaagtgagaataaggacaggaattggtgacaaagagaaacacaataaaaccaaagaggactaaaaaaaggtataactttaaaaatattaaaacaatagacctctagagcaagtctaatg

SEQ ID NO: 377838 - DNA, 874 bp, Homo sapiens
gctatttcagctcattttgtctaataacactcatttcttaggtttctgtcttatagcagtagtaagtatccccaatgcaatcctaatcagcaggactgctagcaggcatttggggttttcaaacaatttgtactgatattacttctgatatttcacattaatatgaattatataggttttcgtactaattcacattaatatgaattatgtaggttagggaagtttctttttattcctatttgctaagtttttgttttgttttacttttgtttttgtttttagatagggtctcactaggtcacctaagctgaagtacagtagtggtggcactatcttggctcactgcagcctcgacctcctgggctgaggcaggaggatggttcaagcccaggaggctgaggctatagtgagctatgtttgtaccaccgtacctcagcctgggcgacagaatggaaccctgtcttgaaaaaaaagaggggggaaatgtggacacagacatgcacaacgagaagatcatataaagacctagagaggatatggctgtctacaagccaaggagagaggcctcagaagaaacaaccagcagataccttgatgttgcacttcttgcctccagaactgtgaggaaataaatctctgttgtttaagccaaccagtctgtgatactttgttacagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377839 - DNA, 390 bp, Homo sapiens
tgatccggcttgttttccccagatgcaggcctggggtagtctcctttctggactgagaagagaagaatggagaagcccctcttcccattagtgcctttgcattggtttggctttggctacacagcactggttgtttctggtgggatcgttggctatgtaaaaacaggaatctagaaaactgtatctgaagttgttcctacctgaagccgttgcattgagaggtgctaatagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377840 - DNA, 1350 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaggggcccgtttttaaaaccgttatacttggaaaacccgtggggttccccaatttaaaccctttgggaaaaaacccctcttttcccactggggttatatttcacaaaggcccccccaatttgccttttcaaaaaatgtcgctcctctattggctaatgcgaattctcacggctaaatattttgtgaaaatccccggtaaattttggtgccggccttttttcccc

SEQ ID NO: 377841 - DNA, 877 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataata

SEQ ID NO: 377842 - DNA, 1012 bp, Homo sapiens
acctgtgggccagaaacttgggtttgagtcccagctctagctttgcttagttgtgtgactctcagaaagtcatccaacctctgtggtgcttattttcagtgatagtacctgtgggcacataggacctgtggggaatgattaccttttagccccatcctatgacaatatggtttgtttttaaatccaggttagcactgacttctcactgacttctcttgtgttttcagagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataata

SEQ ID NO: 377843 - DNA, 902 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattgcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataata

SEQ ID NO: 377844 - DNA, 1248 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaggggcccgtttttaaaaccgttatacttggaaaacccgtggggttccccaatttaaaccctttgggaaaaaacccctcttttcccactggggttatatttcacaaaggcccccccaatttgccttttcaaaaaatgtcgctcctctattggctaatgcgaattctcacggctaaatattttgtgaaaatccccggtaaattttggtgccggccttttttcccc

SEQ ID NO: 377845 - DNA, 790 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccaggaatctagaaaactgtatctgaagttgttcctacctgaagccgttgcattgagaggtgctaagtggatcctctggccagctgactgcacttcttttttgagaaaggaaggaatatatcctgactgattcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377846 - DNA, 839 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccaggaatctagaaaactgtatctgaagttgttcctacctgaagccgttgcattgagaggtgctaagtggatcctctggccagctgactgcacttcttttttgagaaaggaaggaatatatcctgactgattgtggagcactgcccaacacacagtagatactgcatgtggcagacacacgcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377847 - DNA, 557 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctaggtgggccacatccaatcagtggaaggtcttaagagcaaaaactgaggttcctcagagaagaaggaaatgttttaagacttcagcatcaattcctgcctgagtttctagcctgctggcctgctctacaaatttcaagcttgctagccctcacaatcacatgaataaattccttaaaataaaatca

SEQ ID NO: 377848 - DNA, 571 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377849 - DNA, 581 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctaggaatctagaaaactgtatctgaagttgttcctacctgaagccgttgcattgagaggtgctaagtggatcctctggccagctgactgcacttcttttttgagaaaggaaggaatatatcctgactgattgatctggctctgttatccaggttggagtgcagtggagcaatcatggctcactacagcctcaccctcccgggctcaaaaga

SEQ ID NO: 377850 - DNA, 758 bp, Homo sapiens
acctgtgggccagaaacttgggtttgagtcccagctctagctttgcttagttgtgtgactctcagaaagtcatccaacctctgtggtgcttattttcagtgatagtacctgtgggcacataggacctgtggggaatgattaccttttagccccatcctatgacaatatggtttgtttttaaatccaggttagcactgacttctcactgacttctcttgtgttttcagagtgcctttgcattggtttggctttggctacacagcactggttgtttctggtgggatcgttggctatgtaaaaacaggaatctagaaaactgtatctgaagttgttcctacctgaagccgttgcattgagaggtgctaagtggatcctctggccagctgactgcacttcttttttgagaaaggaaggaatatatcctgactgattatagggtctcactaggtcacctaagctgaagtacagtagtggtggcactatcttggctcactgcagcctcgacctcctgggctcaagcaatcctcccacctcagcctcccgagtggctgggactatagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377851 - DNA, 774 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggaatctagaaaactgtatctgaagttgttcctacctgaagccgttgcattgagaggtgctaagtggatcctctggccagctgactgcacttcttttttgagaaaggaaggaatatatcctgactgattgtggagcactgcccaacacacagtagatactgcatgtggcagacacacgatagggtctcactaggtcacctaagctgaagtacagtagtggtggcactatcttggctcactgcagcctcgacctcctgggctcaagcaatcctcccacctcagcctcccgagtggctgggactatagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377852 - DNA, 469 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377853 - DNA, 372 bp, Homo sapiens
ggatcactggacctgtgggccagaaacttgggtttgagtcccagctctagctttgcttagttgtgtgactctcagaaagtcatccaacctctgtggtgcttattttcagtgatagtacctgtgggcacataggacctgtggggaatgattaccttttagccccatcctatgacaatatggtttgtttttaaatccaggttagcactgacttctcactgacttctcttgtgttttcagagtgcctttgcattggtttggctttggctacacagcactggttgtttctggtgggatcgttggctatgtaaaaacaggtagggttttgttgttacttagcctcttaacatcttcacgttgttccagtgaaatgtg

SEQ ID NO: 377854 - DNA, 979 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataata

SEQ ID NO: 377855 - DNA, 1606 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagatggagtatggctcttgttgcccaagctggggtgcaatggtgcgatctcagctcattgcaacctccacctcccaggttcaagcgattctcctgccttaccctcctgagtagctgggatttcaggtgtgcaccaccacacccagctaattttttgtatttttagtagagatggggtttcaccatgttggccaggctggtcttgaactgacctcaggtgatccacctgtcttgcctcccaaagtgctggaattacaggcatgagccaccgcaccaggccaagatctaattctttttaatggcttttaagttgtacggatgattactatttagtttactattcccctactgatagaaatatgtcttgtttaatgcctttgatagccgggagcagtggctcatgcttgtaatcccaacactttgggaggctgaggtgggcagatcccctgaggcctttgatattacaaaggatggtgtaccaagaaatatcctcatggaaatccccgtgaacatgtgcaaaggaatctgtaggttacattcctaaatgctgagtcagagcatctcagcatttaaaattgtgattgccttcagaagaggatgcaccaatttatcctcccactagtggtggctttgtgtaattggactttgtaaaaatctttgacacattaagctggaagtctgcaaacttgttctgtaaagggccagatagtgaatattttaggcttctcaggccatctgtgtcccagctgttcacctctgcctttgtagaatgaaagcagccacagccaatcaataaacgagtgtgactgttccaataaaactatgtatgggccctgaaatctggatttcatatgatttctacatatcacaaaatagtcttattttgatttttttcaaccatttcaaaatgcaaatctattcttagcttgctctctgcacaaaaacaggcaatggactagaattggctcactgaccatagtcatgcctgtaagagttaaagaaagaagaaagaaacatgaaacgtggctttgtagtcaaagacaggttttctttacttaaaacctgagaggcttcccggctaatttcggttaggagcactttctcttacagaccctgcacttgatggatcacctggcaccgcccaa

SEQ ID NO: 377856 - DNA, 1184 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccaggaatctagaaaactgtatctgaagttgttcctacctgaagccgttgcattgagaggtgctaagtggatcctctggccagctgactgcacttcttttttgagaaaggaaggaatatatcctgactgattatagggtctcactaggtcacctaagctgaagtacagtagtggtggcactatcttggctcactgcagcctcgacctcctgggctgaggcaggaggatggttcaagcccaggaggctgaggctatagtgagctatgtttgtaccaccgtacctcagcctgggcgacagaatggaaccctgtcttgaaaaaaaagaggggggaaatgtggacacagacatgcacaacgagaagatcatataaagacctagagaggatatggctgtctacaagccaaggagagaggcctcagaagaaacaaccagcagataccttgatgttgcacttcttgcctccagaactgtgaggaaataaatctctgttgtttaagccaaccagtctgtgatactttgttacagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377857 - DNA, 918 bp, Homo sapiens
tcccgcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccaggaatctagaaaactgtatctgaagttgttcctacctgaagccgttgcattgagaggtgctaagtggatcctctggccagctgactgcacttcttttttgagaaaggaaggaatatatcctgactgattatagggtctcactaggtcacctaagctgaagtacagtagtggtggcactatcttggctcactgcagcctcgacctcctgggctcaagcaatcctcccacctcagcctcccgagtggctgggactatagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaat

SEQ ID NO: 377858 - DNA, 512 bp, Homo sapiens
cacggccagctaatttttgtattttttagtagagacagggtttcaccatgttggccaggctggtctcgaactgagctcaagcgatccactcacctctgcctcccaaagtgctgggattacaggcatgagccactgcacccaggcggaaccacctttttgaagaattacagaacgaatgtataggaaaaggggacagcctgtgcaaagtccctgaggtgatcagatattccaggaactggcagagaccttcttggctacagcatagtgatcagagtaaaatgagatgaggctggagaggcaggtaacagccttatcatgcagggcctagtttgccataataatgaatttgataaaataatttgtaatcacttttatgaaccaatcatggcacgtcatcatcatatgtcctggcacggtccctcccctgttgtatttatttttccctactcattcttgcccttgtctcccctcccatagtccccactttctcttagttatatgtccccccattt

SEQ ID NO: 377859 - DNA, 2101 bp, Homo sapiens
caactaatacggctaggtacgagcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377860 - DNA, 2547 bp, Homo sapiens
aacatttgtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcccaaaaaaaaaaaacgcaaaaaacactctcagttgttctgatttttcttgttccaaaggcgtccttaaaaacttgggggggtgggccccacggggaattaaccgtgggcacgggggttaccccttgaacg

SEQ ID NO: 377861 - DNA, 2184 bp, Homo sapiens
aacatttgtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377862 - DNA, 3046 bp, Homo sapiens
aacatttgtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattaaaaaaaaaaaaaaaaaaaaaaaaaaaaaaaaaaaaaaaaaaaaaaaaaaaaaaaaaaaaaaaaaaagggggggcggcgccgcctgcaaagaaatcctcccgccgggggaggacaccaaatggcacaagcgacaagccgacgatgtgtttgtgtagcaacaaaaggggggccccccacagaaggagggacagtatcaaaataaagcgagagagagacagcgcgcgagcgaggatgataacaacaagagcggagcaagagaagtgggggagaacaacgcgggtgcacagggagggggaaaacccactggggggggagaagaagagacaccaccaacataaacacgagggggggggggggcgggggccacacaatgggtggggggggcaacacaaatactttctccagccggagagaagatatatttttaaacgagcgtctctcagggaggggagagcataaattatcaaagaaaagagttctgacaagcagggtgtattaatcagaaggggtggtggttacacacacagccaggcgcggggaaaaattaatagagtagcgtcggtagacgagagtaggagaaaagaaatattgttgctgcaccagccgcgagaggaagttatactaaccttgtatgtagcagaaaacaaaaaattatgt

SEQ ID NO: 377863 - DNA, 1310 bp, Homo sapiens
  misc_feature (22)..(22): n is a, c, g, or t
caaagattaagccatgcatgtntaagtacgcacggccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377864 - DNA, 1391 bp, Homo sapiens
aacatttgtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377865 - DNA, 1982 bp, Homo sapiens
aacatttgtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggctacggttgccgatgcccactggtttaggcaaggtctgggcaggtggggcacaaaagagggccccgaacgtatccccggcagcacgagcgcgctgagcacacccacagacacgggcacgagggcccagaggaacgccccgcgagagacccccccgaagagagaaccccccggagtactcagagcacaccg

SEQ ID NO: 377866 - DNA, 1167 bp, Homo sapiens
  misc_feature (891)..(891): n is a, c, g, or t
  misc_feature (904)..(905): n is a, c, g, or t
  misc_feature (907)..(907): n is a, c, g, or t
  misc_feature (910)..(910): n is a, c, g, or t
  misc_feature (924)..(924): n is a, c, g, or t
  misc_feature (940)..(941): n is a, c, g, or t
  misc_feature (944)..(945): n is a, c, g, or t
  misc_feature (947)..(947): n is a, c, g, or t
  misc_feature (951)..(951): n is a, c, g, or t
  misc_feature (964)..(964): n is a, c, g, or t
  misc_feature (966)..(966): n is a, c, g, or t
  misc_feature (971)..(971): n is a, c, g, or t
  misc_feature (979)..(981): n is a, c, g, or t
  misc_feature (986)..(986): n is a, c, g, or t
  misc_feature (989)..(989): n is a, c, g, or t
  misc_feature (1006)..(1006): n is a, c, g, or t
  misc_feature (1060)..(1060): n is a, c, g, or t
  misc_feature (1062)..(1064): n is a, c, g, or t
  misc_feature (1067)..(1068): n is a, c, g, or t
  misc_feature (1072)..(1072): n is a, c, g, or t
  misc_feature (1076)..(1080): n is a, c, g, or t
  misc_feature (1082)..(1083): n is a, c, g, or t
  misc_feature (1085)..(1085): n is a, c, g, or t
  misc_feature (1088)..(1088): n is a, c, g, or t
  misc_feature (1090)..(1090): n is a, c, g, or t
  misc_feature (1092)..(1092): n is a, c, g, or t
  misc_feature (1127)..(1127): n is a, c, g, or t
aacatttgtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatccctnttttccctaatcnntncancaacccttccttcnactattcccctaatannacnnancccnacccaaccacccntnccccncaacaccnnncccancanaaccacaactcccctcntatccttcacacattcaccctatcccccttttcccaacactattccaattttcnannnccnnaacnccannnnnannanccncncnttctccatatttaatcttccaatttttccctcatntttttattattatatatccttaatccccacacacctccat

SEQ ID NO: 377867 - DNA, 208 bp, Homo sapiens
gcggccgcctactactactactgctcgaattcaagcttctaacgatgtacggggacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377868 - DNA, 2418 bp, Homo sapiens
aacatttgtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377869 - DNA, 2176 bp, Homo sapiens
accggccggagctcgaggccggcggcggcgggagagcgacccgggcggcctcgtagcggggccccgctacgagggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377870 - DNA, 2318 bp, Homo sapiens
  misc_feature (57)..(57): n is a, c, g, or t
  misc_feature (60)..(60): n is a, c, g, or t
  misc_feature (65)..(65): n is a, c, g, or t
  misc_feature (106)..(106): n is a, c, g, or t
  misc_feature (128)..(128): n is a, c, g, or t
  misc_feature (156)..(156): n is a, c, g, or t
  misc_feature (163)..(163): n is a, c, g, or t
ctggaagaattcgcggcccgcagtgtggaggaggagtgagccggatgccccacacancgncaggncaaccaaagagctgagctgcttcggggccatgcagccctcntgccagccccctgcccttttcntgccctgtctctgaaccttcagaacatngatcctngccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgcctcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377871 - DNA, 1706 bp, Homo sapiens
caactaatacggctaggtacgagcgcgggtttggtggcgcgtttcagcgaagtcgcacgtgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377872 - DNA, 1321 bp, Homo sapiens
ccccgactagcccgacagccccgactagcccgacagccccgactagcccgacagccccgactagcccgacagccccgactagcccgacaggcccgactagcccgacagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377873 - DNA, 478 bp, Homo sapiens
gcggcgcctactactactaaattcgcggccgcgtcgacagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactcc

SEQ ID NO: 377874 - DNA, 325 bp, Homo sapiens
gcaaaaagtagagaggaagcaaaggttgtaggaattgagaaagtcacagaaccctaatagcttcatggtgtaaagagagggagaaagaaatgtagcattctgttagtgctaaaagaacacatatatttctgatcatatcattcatttaacaaataactattagagcatcaacccatgtgctaggtactattccaggtcctgggggaaaaaaacaataaataaaacatttattgtgggctttatattctggtaaggaagatacacaatataaaatgtcagatacagtttcctttctctgcagcccttctcaattgtgtctctgttc

SEQ ID NO: 377875 - DNA, 215 bp, Homo sapiens
tttttttttgctgctctgcaaggagcagggctaactttaaggccagagttggccttaagatgtattcttgaaatatacatttctgcttgtgggagcactcagagattactagaagttttttaaaagaaagttttcaaaaactggataatgctcttctttgttctatacagaaatcatgtttaatcttatacagaacaaagattaaaccagctgag

SEQ ID NO: 377876 - DNA, 603 bp, Homo sapiens
ttaaggattagaagtaaaatttttagcctttcagagttttcattgacttaattaaaaaacatacatgtgttttaggagattccatggtagaatagaaattgtacagtcttcaatgccatatataacagacccctctttaggttttggctctaccacttacaaactctgtggccttcaataagatacttggcttctttcattttaaatttgtcatggataaaatgatctctgtggctatgaaaagttagaacacataatcctacaagaacataatatttttaaacattatttatgtttccaagcccatctttaaaagttattcaacctataaatgaatctataaaatatagttgaagtgcagtgccaatgctactatagaaacaaataatatttatgataatatttctttgggaaaatacattgatgtccagcatgttagcactaaagcaaaaggactgggaattatccagatgtgagctactccacaatcccatatttggagctagagttcagtgtgtgggtggatggcgagtgatgggacagaaggacagaactggagatcttagggagagaatggttaaaaacaaaataagggcctggtgt

SEQ ID NO: 377877 - DNA, 998 bp, Homo sapiens
gaggtggggttttaccatgttgcccaggctggtgttgaacttctggactcaagtgatcttcctgccttggcctcccaaagtgctggtattacagacatgggacaccactcccggctgttctttctttaaaagtaataacgaagttctatttatttttatttttctgtatctccagagcctcaaaatgtacatttccaattctggtattttcctataccagtgaatggaaatagatgactatagagagtaaattggtttaccaattcagtaaataatattctgaatagttttggaaaattctatggaaacatttagaaattaccatattttttgtgagagaccaggaccctaacattaggacctacacttgcctgttggatttgaatttcaatcttatagatacctcatactgaggtctaaatctaaatttctcttcattcaaattagtttctttctgaggcttggtatttcatattcctcttagctttttctctcctatttctgggtgctagttaaggtggatggaatactataatatatcttgctctgtcctctttgattcccattgttgtcttcctcttccacgtcatcattggctcatgcctgcactagtggaatattcttttaattggtttgtcttcctgcagtctcttcttttggctgaacaacctaaaaaccctaatttgatggacatactttcttgttcaaaaatctaaaatactatttattgctttccttaattaatcacagctgattttttggtccgtgtaaaaaaaacttgagtggttttattggttgcaggggttcctagtgggaaccctaacgtatcctatttaactatgactctactgggtctggtagtggacatataattgataagactagatagtgtggaccaccccccctgctgagagcaattacaaaaatcagaccacaggactaacaaagtgaattatagggccaggatctaagagaagaaggaaactcagatagaggaa

SEQ ID NO: 377878 - DNA, 867 bp, Homo sapiens
  misc_feature (320)..(320): n is a, c, g, or t
cgtgaacccgggaggcagagcttgcagggaggcggacttgcagcgagccgagatagtgccactgcagtggggcctgggcaaagagtgagactccatctcaaaaaaaaaaaaaaagaaagaaatgtgttgctggtatcagatatcagaccaagaacacttcagtctctctaaggatgccctgagctacctcactgttaaaggacgacatcaacacagaatgcactaaacaggaaataagctgtaatctagagaatttccattatgtgttactttttggtgactaacatggaatgttgaaaaggaagagctggaaagctcangttgttttccttgttcctctgacattgtccaggcaagagggcatcctgatcagatgagtagatttggctgagaaaaaccctagagtaaggcaggcactttgtggaggtggatgatgatggctcataaaaacgtttgttctcagtccagttcagggctctgccagcagtctttcagatttgaactgcttaaacaaaccctacagataaattggcactctgatttgtaattctgtttgtacaagtttagagcagcctagctcgagtcctcaaccccagtcctcttagaagtgaactgattgcactggatccctaaacccacaatgttgaggacacatgtgatgactccacttgctcagccagctggcctcttgcactttcccctgcccaccacttgtaactaccacttaattatcttgtgttaattgcttttgttgtgttgggtctgtatttttgtggtcagtgcctgcaggcagaaatgtgaaagcatttggtatgttgaagatacttgcttcttttttaataaaattaaaagtgcagcaaaaaaaaa

SEQ ID NO: 377879 - DNA, 360 bp, Homo sapiens
  misc_feature (1)..(1): n is a, c, g, or t
ngtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccag

SEQ ID NO: 377880 - DNA, 1916 bp, Homo sapiens
  misc_feature (1137)..(1137): n is a, c, g, or t
aagagttaaatgaaatactggttttttaaatggttagaacagagactgatgcacataagtattcattattataattcagtttttgcattctttaaagtgaagctgtgttgttgcagtattttaaggatatattgttccccaaatttttgggtaaaattgactgttaaggaagatgagtcatgtttaaactgtaattgtgagtagaccaccctttatccttgaagggctttctcaaccaggtgaatggcatggctgtggtgggaaatacagggccctgtgagacaggaaatctagggggttgtctagctccattaccatcctcttcttttatggattcagtgtcttgttcttttgttccatgtgagaatcatccctgccctgcctacgttataaagctggagaaaaatgaaataagtaaaaacacatggaaaacgtactaaaatattaatgcaaggatgcaaggtataatctttgctggaacattagttcctcatttattagtaacattacaggcatttgaaattatgtactttatatgggacctatattttaaatatatgctaatcatcctagaagccctacaaggtaggtgttacttttttccattttaccattaaggaaattatccaggtttacacaacttgaacccaggtctctgtcagtaaaaaactgtctactcttccaaaccattttatctatccatatttatttcctccatcaaacattagttgaatgcaatgtggtgtatcacccaaggtcggctggcatcttgaaaacaataactatgtgttactcagcatcttagcacctagcaaagagtggagaatataacagtctttcaattaagttttgtcgaagaaagaaatgaaggctcttggtctttagaaattcacaaatcagctgaggagacagacatactaaccaacagcatatgatcagcatgttctaattggtactgtctctggaataaaacagctggcagcaaaaaatgtctgacttttgcagagaaactcctaatatgagtttgactgctgtcccacatctacctatgtggtcgtagtgctgtagtcactgttgttaccctaagaggacagccttgttcctccaggtctcttacaactctcttttaaggagctngtattagatccctagagctgctgtaatgcattgcccaaatcttgtgacttaaaccaacagaaatttattatctcatagttctggaggctagaagcctgaaatgaaggtgtctgcaggcttcactctctctgaaatttttatgagaacatttttcatgtgatttagagcccacctgggtaatccaggatgatatcatctcaagattcctaacttaattacacctgtaaaatccatttttccaaataaggtcatattcacaagttctgaagactaaggcatggacagatctcattggaaaccatcattcaacccactgcaaagctttagccaattcccagctatgaattcttccaagatgaaaggataccaagctcaagactctcccttgttcatttgaggccttcccaaagatgactgacattttcacaaattttatttggtttcatttcctatcttaacgaaaacaatgataatttcctatcttaatgaaaaaaatgataatgtttatactgtatgataattaaaacatcatgtaaagattactctttatctaaatgtttgcacatactctttgaacatctatcatttttccagcagttatgagtttttcttcccaggaatatgggaatgaagtgaaattgacaacttttcccccacgcattgtatcctcttttaatgccaccccctgtgtttaacagcctctgacacaatgtaggagcaatccatggtactcaaagaatattatggaatttaacaacaagtatatatatttgtcttga

SEQ ID NO: 377881 - DNA, 543 bp, Homo sapiens
cagccctgtgctcttgtctgtcctcactgacagacaaaaataactcatcagtcggttctcagacccacagtcccatgacatttcttgactgtttcagaagtaatgcctcaaggaccagcttgcagaaagtggaggacctgccccctggaccttacaagtagcaggccactcttaaaaatgcaaggaccacagatgtcaccatgactgaaaaatagaggctggccctgcctctgaagatgctgcaatggacttgtgttcaaagagaaattggctgtaacttcccttattgagatataatcgggctcatcgttaagctgtggtcagccagaagtgtagctgtgcccctgggattgaaatcagcaatcaatctggacatcctttttctatcttcatgaggcacctccccagtaccaaccaaatttcttggggatcccccgggacttctcataaatggaattgatttgaactcaggaaaccctcaaataggccagaacaactcactaattaaattcatcccctcccaaaaacaaaaacaaaaacaaa

SEQ ID NO: 377882 - DNA, 571 bp, Homo sapiens
aaggtcgccagcttcgggccagatgttgactagagccgcaaggatttttgggaactgtagtctagagcaggaaggggtgaggcgctggggcaagtggaaggaggtcgcttaaatgacttcctgccccaagccgactcagtgcagaacgcacccaggaccccggactgtactaggcgttataacgctctctgagaatgctagactgactaaatcgtcatttttgccttcatccgtggataagccacatactgtatgactgcatttataggaaatatttaaaatagtcaaatctacggaaaaggagtaagttagagttttttaggactagcaggattagggggaactgtgagtgattggtaatagctaaagggttcatttttggggtaatgcaaagcttcttgaattagataatgatgtttgcacaactctgaatacactaaaagtgactgaatggtacaccataaacgagctaatgttatagtttgtaaattatatttgtgtgcatgttttttaaaaatcaactttactgaagaataatttagatacaataaaatgcactcattttaagtga

SEQ ID NO: 377883 - DNA, 652 bp, Homo sapiens
aaggtcgccagcttcgggccagatgttgactagagccgcaaggatttttgggaactgtagtctagagcaggaaggggtgaggcgctggggcaagtggaaggaggtcgcttaaatgacttcctgccccaagccgactcagtgcagaacgcacccaggaccccggactgtactaggcgttataacgctctctgagaatgctagactgactaaatcgtcatttttgccttcatccgtggataagccacatactgtatgactgcatttataggaaatatttaaaatagtcaaatctacggaaaaggagtaagttagagttttttaggactagcaggattagggggaactgtgagtgattggtaatagctaaagggttcatttttggggtaatgcaaagcttcttgaattagataatgatgtttgcacaactctgaatacactaaaagtgactgaatggtacaccataaacgagctaatgttatagtttgtaaattatatttgtgtgcatgttttttaaaaatcaactttactgaagaataatttagatacaataaaatgcactcattttaagtgaactgttcggtaagcttcaacgcatgtctaaacccttgtcaccaccatcgtaatcaggatatagaatattttttaaaattaa

SEQ ID NO: 377884 - DNA, 2785 bp, Homo sapiens
gggaaaggctttacttctatttcacgacttaatagacaccgaataattcatactggagagaaattgtataattgtaatgaatgtggtaaagccttaagctcccactcaacacttattattcatgagcgaattcatactggagaaaaaccatgtaaatgtaaagtatgtggaaaagccttcagacagagttccgctctcattcaacatcagagaatgcatactggagaaagaccctataagtgtaacgaatgtgacaaaacattcaggtgtaactcatcgcttagtaatcaccagagaattcatactggagagaaaccatatcgatgtttagaatgtgggatgtcttttggccaaagtgcagctcttatacaacatcagaggattcatacaggagaaaaaccctttaaatgtaatacatgtggaaaaacttttagacaaagctcatcacttattgcacatcaaagaattcatactggagagaaaccctatgaatgtaatgcatgtgggaaactctttagccagaggtcatcccttactaatcattataaaattcacattgaagaggactccttaaaagccgatttgcatgtgtgaaagccttaaaccaaaactcatcagagaatacatgcttgagagtgatttattaaatataatgaatatgagaaaactcttagttctcatcagatactaagttttaagaataaactttagctatgtaataacttatgggaaaagcttttatacttgtcactcactttttaaaatatcccgagacagttcactgttgcagacattgaaattggccatttgtaagataaaagaatacaaatggagagatttgcatgggatgcagaaatatggaagactaaccaagcagaccaggagagaccagcaatagtgtcccagagaccatgatgtctgagcccagttttggaagaatactttctttccaggctgggcatggtggctcacacctgtaatcccagcactttgggaggccaagacaagaggattgcttgagcccaggaaggagttggagaccagcctgagcaacaacaacaacaaaattagccaggcataagtggtgcacatttgtagtccagctactctggaggttgaggtaagaagaattgcttgagctcaggaggttgaggctgcagtgagctgtgatcccaccactgcactccagcttggggaaagagcaagactctgcctcccccacatgcgcccccccacccctgcccctgccagaaaaattgtttgtggatccctgttatcagaataaggacattccctcatattcctagtgtgatgtgagtttttatcataaaagggagtagtattttgtcatgtccattttctgcattggttgaaatgatcattttgtttttctcttcattcttttaatagataattgtttgaattttggtgttaaccaatgtttcattcctgaaataaattctacttggtcatgatatatcatcatgtatgtgtatatgtatataagatcaggtttcttccttagtaaacagaagcctgatgaagtgcccaacgttgtgttctaagaacttagagcaaaaggaaattatccaagtctcaaggaaagatgtaataatacatggaaatgaggtactcttggaaggcaaggcctgggagcaaaaggctcagaggaagaataaatctagcatttgtagggacctgtagggagactggctttgctggtgtagagggctcctggtaggataaaataaaaatatttgaaatgaaagctacagttaccctgtcagagactttgaatgctgtctaagactgtaggagtttggatatgatgatggacatattaattcactatatttctgaggagcaaatgaccaatttgagactattttaggaagaattatctgatagaatagatgattcaaagattatttgatcatttctgattatgatcaaatgattcaaagattatctgatcattgagaaactgaaggactgattgttgggagtaggtctttgggcgagtctgtgagaagagttcttaatgagaactaaaaaggttatttctgttcttggtgtcccaaactgttctggtattttgccaaatactacagatagtaaaattcttaattaaagctgacatggttatatttttaaaaatttaggtgcaattagtctttcaagatcagaagatatttagttagtatcatagttcagtctgttccaagctgtaaagtcagttatttcagtaatgtaatttctaagatctataaaaaatgaaaatattttattttcttatataactttctgtgagagcattgaacagtcaagaaacttgtatgttttccagcccccattctgcttcaagttacatggtgtctagccttttcagctctagaaattctacattattatgtaatatcctgctttatgggtcttggtggtatatggtatagatcaactcaaaatttaaaattttcatcgtatgaatttttgtgtagagatttcaagatgagttgatctgagaacaaaaagaactccaaagaaatcttactattttcctgttggtatatattgttcaataaaacactatattggtatatattgttcaataaaacactatattggtatatattgttcaataaaataattatgtattacgaattaaattttcaacctaaaaatcagattattccaggaagatggaatagacagatgtacctttccttatttatcccatacatctgaaaccttgtatattataaataaacataagactctggtgagt

SEQ ID NO: 377885 - DNA, 1780 bp, Homo sapiens
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgtaaaaaaaaaa

SEQ ID NO: 377886 - DNA, 892 bp, Homo sapiens
  misc_feature (79)..(79): n is a, c, g, or t
tggcgatacattcacacagaacagttgactgatacgattatacgactcatataggaattgccctcgagccagaatcgcnacgagccaggggagggccccagagaaaaccagaaagagggtgagagactgaggaagataaagcgtcccaggcctcctacaccagcgcctgagcaggaagggggaggggccatgactacgaggccctgggaggtcactttagggagggctgtcctgaaacctggagcctggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgcccaggtctttcatcagagccccatttcaagtgctcagtagcccctttggccagtgcgccccaccacatgggacagcgcaggtccagtggcctccccagctgaccgcaggcagggaacaaggcagaccctagagggccaggccacagcaggggctgaggatgcctggtgaatggatgcctgggagaatggatgccagaattcacgcatgaggctctgaacagggctgggaaaacttccaaacgaagggaagctcatgtcttggtgcactttgtgatgatgcttcaacagcaggactgagatggggacatttacaataaacagaaatgtatgggctcgaaaaaaagcctctgggaagtccactgtcaatgcaccagcaactttccagggcctgcgagctgcacagtcac

SEQ ID NO: 377887 - DNA, 1061 bp, Homo sapiens
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtaccacccggactccaatcactttgcaggcaggagctaagccagctgggaaagcaaaccacgcactgataagtgaagtgcccggcggcgggctatccagtgtgtccttctctcccacactttccaagtccgtggccctgaccttcctgctggaccgtcctgggatcggatcgtggagggggtttgcctctgcacaaaaggccttgtgtttccgtttttcttttcttttcttttttcttttttttttttgagacagagtttcactcttgttgctcaggctggagtgcaatgacgcgatctcggctcacagcaacctctgcctcctgggttcaagcgatgctgtcgcctcagactcgcaagtagctgcgattacaggtgcccaccaccacgcccagctgattttttttttgtatttttagtacagatggggtttcaccatattcaccaggctggtctcgaacttctgacctcaggtgatccacctgcctcggcctcccaaagtgttgggattacaggtgtgagccacagcgccggcctaattttaatatttaattaatccaatgtggctaacatattacttcaacattaattaacat

SEQ ID NO: 377888 - DNA, 387 bp, Homo sapiens
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcaactttgggaggccaaggcgggcagatcacctgaagttagatattcaaaaccggcctgggcaacatggtgaaatcccatctctactaaaaatacaaaaaaaaaaaaaattagccaggcatggtggcagtcacctgtaatcccagctactcgggaggctgaggcaggagaaccgcttgatcccatgaggca

SEQ ID NO: 377889 - DNA, 1780 bp, Homo sapiens
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcaaatgctgcgggatgctggggcccaagtctccatcatgacctacgatgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgtaaaaaaaaaa

SEQ ID NO: 377890 - DNA, 1780 bp, Homo sapiens
  misc_feature (1705)..(1705): n is a, c, g, or t
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatattcccagaatagttttcaatgtantaatgaagtgattaattggctccatatttagactaataaaacattaagaatcttccataaaaaaaaaaaagtcga

SEQ ID NO: 377891 - DNA, 1796 bp, Homo sapiens
  misc_feature (79)..(79): n is a, c, g, or t
tggcgatacattcacacagaacagttgactgatacgattatacgactcatataggaattgccctcgagccagaatcgcnacgagccaggggagggccccagagaaaaccagaaagagggtgagagactgaggaagataaagcgtcccaggcctcctacaccagcgcctgagcaggaagggggaggggccatgactacgaggccctgggaggtcactttagggagggctgtcctgaaacctggagcctggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgtaaaaaaaaaa

SEQ ID NO: 377892 - DNA, 1613 bp, Homo sapiens
gaaagaggggctgaagtcgcccttgaataaccacagcagtggcacccacaaaggtgcagttcccacagcctcatagctgcttgtaggtgccacctcttaaggccattaccatagcaattaatactgaacatgagctttggagcagacaaacactcaaaccgaacagggggatggaggaaaggagcttcaatggcaagatctcctggactcctgtcctggcccctcctccccctgccccacccctgctctcctcctgctccccctctcagagcttgccctgaccctgctcctctcccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgtaaaaaaaaaa

SEQ ID NO: 377893 - DNA, 1216 bp, Homo sapiens
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgtaaaaaaaaaa

SEQ ID NO: 377894 - DNA, 964 bp, Homo sapiens
gagcggcctgtctttatcagaggtccctctgccagggggagggccccagagaaaaccagaaagagggtgagagactgaggaagataaagcgtcccaggcctcctacaccagcgcctgagcaggaagggggaggggccatgactacgaggccctgggaggtcactttagggagggctgtcctgaaacctggagcctggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgtattcccagcctgagcaccacgcagaaatgtgcttcctctcttggttctgtggcaaccagctgcctgcttacaagtgtttccagatcacctggtttgtatcctggaccccctgcccggactgtgtggcgaagctggccgaattcctggctgagcaccccaatgtcaccctgaccatctccgccgcccgcctctactactactgggaaagagattaccgaagggcgctctgcaggctgagtcaggcaggggcccgcgtgaagattatggacgatgaagaatttgcatactgctgggaaaactttgtgtacagtgaaggtcagccattcatgccttggtacaaattcgatgacaattatgcattcctgcaccgcacgctaaaggagattctcagaaacccgatggaggcaatgtatccacacatattctacttccactttaaaaacctacgcaaagcctatggtcggaacgaaagctggctgtgcttcaccatggaagttgtaaagcaccactcacctgtctcctggaagaggg

SEQ ID NO: 377895 - DNA, 386 bp, Homo sapiens
gagggcagatcacctgaggttgggagtttgagaccagcctgaaccacatggagaaaccccttttctactagaaatacaaaattagcctggtgtggtggtgcatgcctgtaatcctagctacttgtacactccagcctgggcaacaagagtgaaactctgtctcaaaaaaaaaaaagattacctcatggcttgctttcttttctaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtga

SEQ ID NO: 377896 - DNA, 2337 bp, Homo sapiens
gaaagaggggctgaagtcgcccttgaataaccacagcagtggcacccacaaaggtgcagttcccacagcctcatagctgcttgtaggtgccacctcttaaggccattaccatagcaattaatactgaacatgagctttggagcagacaaacactcaaaccgaacagggggatggaggaaaggagcttcaatggcaagatctcctggactcctgtcctggcccctcctccccctgccccacccctgctctcctcctgctccccctctcagagcttgccctgaccctgctcctctcccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcaggtgagggtctccctccaggctcatcgcctcgctcctctcacctcctgctcatcctcttgaggcctcccctctgttccagaccaggtcctctcctggccaggccctcctgccttccctcctgccccctgcctgccctcgtggttacactccctcacccacactcctcgtgctccctccacctccctgcctcccacctgctttcctgggcccttcctgtgagtgagaggccccttctgcctccagagcaacctccatccacccccacagcctgggagccccaacctggccccttccatctccctggcataaccgaatttgtcgtaaaactggacgtagtaagtgggcatgaatagtcacaagcccggcagtcagaagctttgagcaacatccttaaaggccaacctgagcccctgagaaggagctgcctccatggaaacagagcttcaggcttcggctgccatagaagatggccgggctgggtgcccacagggcaggcatttattttctcacacatctggaggctgcaagtccaaggtggaggggtgggcggggttgtgtcttctgcagtcgctcctcctggctggcagggggtcccttccggccctgtcctctctggcctttcctctgtgcacctgcactcgtggggtctctctgcctccaaatgtcctcctcgtttatggaccccagtcatgtgaatttgggcccacactgaaggtctcatttaagttaatcatctgatgaaaggacctgtctccaggccaggtgcagaggctcatgcctgtaatcccagcactttgggagtccaaggcgggtggatcacctgaggtcaggagttcgacaccagcctggccaacatgttaaaaccccatctctaccaaaaatacaaaaattagccgggagtggtggtgggcgcctataattctagctactcggaaggctgaggcaggagaatcgcttgaacccgggaggcggaggttgcggtgagcccagactgcgccgctgcactccagcctgggcaaaaaagcgaaacttcttctcaaacaaacaaacaagaaagaaaggacctgtttccaaatacagccaccctttgagggagcgggggttaaggcttcaatacattgattttggggagaaacagtgaaggccacggcaagaagctgcagtcattgtgggcgggcctgggtggggagtgcaggggttcctgtcctgtgtgtctgtttcccaggggagtcctgacctgactctcacagcccctccacccagatgttcctgtgtgcttcacccaccccattccttctgcacccaacactcctgagcccctccttagctcccccgacaggctcccctgctcccccactcccgggctgctcctcttctcagcctctctctgggcctctctggggtccggacatgacccctcagctgatgcctgtggcttccccagccagaatcttcccagttccaggctgggctctgcagagtcctatcaaaggtggcatcctcccctctgtccactccagggtgaagatctggtgtttctggtttggaaatgcctctgcactgggtgctaataattcacttttacctttataattgtggttttgtaaggacaggtatttttggcaacag

SEQ ID NO: 377897 - DNA, 571 bp, Homo sapiens
agtccgtggccctgaccttcctgctggaccgtcctgggatcggatcgtggagggggtttgcctttgcactccagcctgggcaacaagagtgaaactacgtctcaaaacaaaaacaaaaaacaaaaaaagataaatgagcggtgtatggtgtatttttcaggtgcccaggtctttcatcagagccccatttcaagtgctcagtagcccctttggccagtgcgccccaccacatgggacagcgcaggtccagtggcctccccagctgaccgcaggcagggaacaaggcagaccctagagggccaggccacagcaggggctgaggatgcctggtgaatggatgcctgggagaatggatgccagaattcacgcatgaggctctgaacagggctgggaaaacttccaaacgaagggaagctcatgtcttggtgcactttgtgatgatgcttcaacagcaggactgagatggggacatttacaataaacagaaatgtatgggctcgaaaaaaagcctctgggaagtccactgtcaatgcaccagcaactttccagggcctgcgagctgcacagtcac

SEQ ID NO: 377898 - DNA, 1726 bp, Homo sapiens
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccgaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgtaaaaaaaaaa

SEQ ID NO: 377899 - DNA, 1626 bp, Homo sapiens
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgtaaaaaaaaaa

SEQ ID NO: 377900 - DNA, 1599 bp, Homo sapiens
gttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgtaaaaaaaaaa

SEQ ID NO: 377901 - DNA, 692 bp, Homo sapiens
catcattggcacattactgcaaaatgatggcagagatattttcaagaatgtacatcaagttatatttccttgacatccttttttcaattggtcaaggttacagattcagaggataaagggtagtttcatttagaataaattcatgtctactggcaatctatatataaaagtgacctgcccaagaaccaaaaactttaaatgctaatgaagcttttgaaaaataatttttaaacaaattaattttaaaagggtgttacacgtacccagtttttactttttagttgatgaaacccatcctataatatacatttgagcaaagtacacatattaagaaaaacatggacatttacttgtttaatagtcaaaatgatgaggaaatgttagctgtttttaagtgggactggtggggtgtcctttgtcacaaggaatgcttttttagcttgtttgtgggcataagagatgttaaccctttgctgattctaccacacaactgtaaagaacctaatgaatctacaagtttaatattcagaaaaagctaggaactccgctctttaccagtacagtggaacaggcccgttattcaaggtgatgcctcacagctatagaacaactattcaaagacccagagttaaatggtacatgtgtatatgtgtgtgtgtgtgtgcacacgcacacacttcagataagtatca

SEQ ID NO: 377902 - DNA, 681 bp, Homo sapiens
gagttagtgggtgcagcgcaccagcatggcacatgtatacatatgtaactaacctgcacaatgtgcacatgtaccctaaaacttaaagtataataataaaagaaaaaaaagatttgtataatacattacaaaaattaataacatgctttcactacgttgaagtgacttacatagctagtagtagaatcagatgaagtggtagaatcagttgagcccattttcttttgttttgatggaacatatgaaactctaagtgtttcagtcattatcttagccgttaaaagcttatactctggagtcagcagatcaagatttactatttacttacatgagtaacctttggaaagttattgatcctctctaaccttctgcttcccttctgtaaaatgctaattttaaaatcgttattactgctactaccaacaccactgccaccaccattattaccttagaaattacctattgttattactagattttaatttgaatagattcttaggaaaaaacctgtctttcaaaacatagctttaggggctttattgtactgtatgacacaatacaactctttctggttagttgttatggatatgaacttcatttttgcttcagagaacaagtttgtgctggataaattattttttgagctcaaggtctttcaggaagtttgtagatttttttgta

SEQ ID NO: 377903 - DNA, 1782 bp, Homo sapiens
tgcagatgccctgtgccgtgcagctcagcatgcataggtggggtagttggttgatgagcttttctttaggagaacagattttgagctatctttttttgttggaaccctgcacacaactgtcattatgtagatggttttcctctcaggtggttggttttctccagagaagaacccttgaatctcctgcctgtggaggtggacgtgtggttggtgttctgggtgccccttgccctgagctctgttctccatggtgcctgtttcctgggtctgcagccccttctcagtttctctgaagagtaaacctctcccctgcttggggaggagcatgggggttacgtagtagcctggctgcataacatgggcttagtagctcagttttccatcatgaaccagagcctcatctttcatggttcctgtgcctccgagggctgggctactggggtgtctgtcagtccagatggctttgttctcaagtttcctccacagtggatatgaatgtttgcaacttacactcaattacaacgctttcctctacttttctccaagtttgctgaaatctttatttgtggatatctcctctctttttgctttgtcctcataggttaaaacgttttaaaattccctaacagtaggaaatttagtagggttttggaagggagaggaggtgtaagatggtcactcttccatgtttaactggaagtggaaagtctaggcttttgcttcaggcctgggaggtgcacatgaaacagtccctcccagtggctgcctggggggtccctgaagggtgtgagaccaccgtgaatcctggggcagggcacttgcagtacatgtgctatgtgtttgctagtattgttttagatgtttgatctcctagcctttgcttttctttgtatttttcctgctttagtccatttcccttctagctccttctgttctcatttatcttctgctgctgcttggagttacattttcagcaagtctgtaacacctctctgaaccaaaggctctcaagttcatctttctttctccaagcctacgcctgtgctgctgtcatgagtggcgagcttctgtttcttctgtcttcttgtcagtcccaagtgcccttttacagagaatgcctgtttttcactgtctagctcagttaccaggagtccctgtgaatgacacccacaggtccctcaaagaagtcagatttctcttggacctgataaagcaaacaaaatgtgacccaagcaggctgagttggacgggtcccttcttaccttcgccctctgccatgttgacattcttatctgatggcacaggctgggagttcaggatccacttagatggggtccgttcaggggataccagcgttcacatttttccttttaagaaagggtcttggcctgaatgttccccatccggacacaggctgcatgtctctgtgagtgtcaaagctgccatgaccatctcggtaacctactcttactccacaatgtctatattcactgcagggctctatgattagtccataatgtaaatgcctggcccaagacgtatggcctgagtttatccaaggcccaaacaattaccaaacattcctcttagatagaagacagatttctttcccttggcaaagatcttctactaagatatgttacaggatgttttacattctcttggtcttataataacaccacgcccaatccagtatttgatgcgtcggtggtcactcggaaggttgttattttaaaaatacttattgttctcagtctgcagttctcacagctgtaaaaaaaa

SEQ ID NO: 377904 - DNA, 1056 bp, Homo sapiens
  misc_feature (1)..(1): n is a, c, g, or t
  misc_feature (5)..(5): n is a, c, g, or t
ntttnggggcccccctttttgggggggggggggggggggtttccccccttggaaaggggtgtgagaccaccgtgaatcctggggcagggcacttgcagtacatgtgctatgtgtttgctagtattgttttagatgtttgatctcctagcctttgcttttctttgtatttttcctgctttagtccatttcccttctagctccttctgttctcatttatcttctgctgctgcttggagttacattttcagcaagtctgtaacacctctctgaaccaaaggctctcaagttcatctttctttctccaagcctacgcctgtgctgctgtcatgagtggcgagcttctgtttcttctgtcttcttgtcagtcccaagtgcccttttacagagaatgcctgtttttcactgtctagctcagttaccaggagtccctgtgaatgacacccacaggtccctcaaagaagtcagatttctcttggacctgataaagcaaacaaaatgtgacccaagcaggctgagttggacgggtcccttcttaccttcgccctctgccatgttgacattcttatctgatggcacaggctgggagttcaggatccacttagatggggtccgttcaggggataccagcgttcacatttttccttttaagaaagggtcttggcctgaatgttccccatccggacacaggctgcatgtctctgtgagtgtcaaagctgccatgaccatctcggtaacctactcttactccacaatgtctatattcactgcagggctctatgattagtccataatgtaaatgcctggcccaagacgtatggcctgagtttatccaaggcccaaacaattaccaaacattcctcttagatagaagacagatttctttcccttggcaaagatcttctactaagatatgttacaggatgttttacattctcttggtcttataataacaccacgcccaatccagtatttgatgcgtcggtggtcactcggaaggttgttattttaaaaatacttattgttctcagtctgcagttctcacagctgtaaaaaaaa

SEQ ID NO: 377905 - DNA, 752 bp, Homo sapiens
agaggattccccggtacgggagtggtgttattataagaccaagagaatgtaaaacatcctgtaacatatcttagtagaagatcttgccaagggaaagaaatctgtcttctatctaagaggaatgtttggtaattgtttgggcccttggataaactcaggccatttctcttggacctgataaagcaaacaaaatgtgacccaagcaggctgagttggacgggtcccttcttaccttcgccctctgccatgttgacattcttatctgatggcacaggctgggagttcaggatccacttagatggggtccgttcaggggataccagcgttcacatttttccttttaagaaagggtcttggcctgaatgttccccatccggacacaggctgcatgtctctgtgagtgtcaaagctgccatgaccatctcggtaacctactcttactccacaatgtctatattcactgcagggctctatgattagtccataatgtaaatgcctggcccaagacgtatggcctgagtttatccaaggcccaaacaattaccaaacattcctcttagatagaagacagatttctttcccttggcaaagatcttctactaagatatgttacaggatgttttacattctcttggtcttataataacaccacgcccaatccagtatttgatgcgtcggtggtcactcggaaggttgttattttaaaaatacttattgttctcagtctgcagttctcacagctgtaaaaaaaa

SEQ ID NO: 377906 - DNA, 2018 bp, Homo sapiens
cgtctccaaagacggagggagccgggaggagacagcacacaggccttgccgtggttcccaccgaccaccctcagctcaccccttgtcctgtcatgcttccccacgacctctgtgtcctcatccaacctagcatagaaagcgctcaggcgttactgtctcttcgggtctccgctgccccttcgggtcgccgctgcctcttcgggtctgcactatctcttccggtctgcgctgccttaggaaggcttccataccacatgggacttactaagtaaatccgtgtaattttctcgttaagcttaacttacagggctccagctgaagaatttaggagggtaggggaaaagggtatattgtttccctcccctgctgttttcttggttgtgagctttgaccattagcaggaacacatttgaaattaaaagttgagagaaaagttcgaatttcgcaggatcagctctgtcccatagaaacatactgtgagctacgtatgtaattttaaaatttctggcagtcacattaagttttttaaaaggtgaaattaattttaatattgtatctgacccaacagatccaaaatattatcacttcaacgtttattaattgaatacagtactttgttttttttggtatttttgtttggtttggtggagacagcatctcgctctgtcacccaaactggagtgcttggggccatcaatgctcactcagcctcggcctcccgggctcaagccatcctacactagaaaggtctgagtcattacagagtggccaccagtgtcatctgaggcacgggtaggtggctcattcagggccacaccagcggctcctttttagtacatgtgaagagtgtaaagcaaaggagaataaggtgtgtaaaaggttgtgccaatggtgactgtcagccacacttcctgccctcttgcttgtcctttcaagtacagagctgtggctcacccagagatgacatttcccattcccccatgcccaggtggggccacgtgaagtagttcttccagatggacgtggctcatgtctcttctgggtgttctccaggcccggggggtggcagataaagggcagagggagacagttcccgagccccacaggctggcatgttgcctgcaagccaggacacctgaactgtcctatgagaccgaagctctggctttcagtcactgaaattcggggggttatttgtccagcagtgagaagtgccgattcagcagttacatctgcttcatggaatccggcttgaagcacaaagaaggatgaaatgaacaagtcccgtggagatctcacacatttagatatgtgatggggaaaatgcattttggatggtccatgactgtccaggtttcaaatattctagtctactggagtcctcacgttcactttttctttcttttttttttttattaatgtggagcaacctggcagaacgtagtgtgtatttaaatcaccagacttctgaaggtgcctttgaggacatggagttctcttccaattctctcccttctgcaaaaagatcgtgagacagcgcagggtcgagtgctgtggagactatgagctgcctttctccctgggatgttagaagaatgagtattggctttaaggatgagaggtccttttgagtaaagaacattctgtgaacacagcaggcagtccacaagggttggggtttgaatgaagggggtggctgaggatcttccaggcacctgtgttttgggattagccgtacttggaagcctggtggaagctgcttttctatttatgagtcaaattctctttcactctgaatgtaattataattgccaagcagctgtatcttaatttagggtcttgaatcggtaacgtttcctaaggctttaattttaattttctttattccttggcctttcaaatatctaataatatctaaataaattattgaaagtagaagagttctctatacattgtaaaaggaaaaattacttggaaatatacacagttacctcccaattgatgctttgtaattcagg

SEQ ID NO: 377907 - DNA, 354 bp, Homo sapiens
ggtcgacaaattagctgccataaacccaacttattcaaagaactttgcttgaactaacaatatttaatgtgcaaaatacttcgtaacctttctgatattaatatcaatagtagatcaacactatgaaaatacatttcttggccaggcatggtggcttacgccggtaatcccagtactttgggaggccaaggtgggcagatcacctgaggtcaggagtttgagatcagcttggccaacatggtgaaacctgtctctactaaaaatacaaaattagccaggcgtggtggtgcatgcctgtaatcccagatactcaggagactgaggtaggagaatcacttgaacccaggaggcaga

SEQ ID NO: 377908 - DNA, 206 bp, Homo sapiens
aaatgtaaaatggagtactgatatatctaactacctcatggagttgagacaaaaatagagttcattaatatgcataaagctcttatcacagtacttggcatatgttacacactaagtgttagctatggacattataatcagtgtagctatatatttatatgcattcatgattatctccttaggttaaattcttgacaatataattg

SEQ ID NO: 377909 - DNA, 539 bp, Homo sapiens
ggacaaaggccattcaaattctttattatacaacaggcatgcttcacactgtcgccatcaaagctacctttgatgggttgcctctttacatcctgagccttcctattccatcaggacatgaatgagggcctaaaatccaccatccccagtcagtcaatagaagttggggaagattagaaatagtttgctgcctgtgaacaggaacagggggtggggggtcactaattatgggcggattcttaatataactctctagattttgtttttattgatacacgagtctgtcctattggcaaattacattcttgaggtcaggaatggtctaattgcctttgtctacaagcacacgtgctgtgtgctcagaaattgtccctctgttggaacagattgcccatctagctttgttgggggcatggtgagttcttttggctgtctgaatgatacagcttagccttattctaggcatccccagccaagaaagctgactcaatgagaaggaatagaggacgagtatggtggctcaagactgtaatcccagc

SEQ ID NO: 377910 - DNA, 277 bp, Homo sapiens
tgcctggtgagcgggtataatcactcttgaagatattttttggataatcattggaaaggactatttttggagatgaagagcttttccaactttcctttggacagaaatgaattcagggagtttgcagcactcgctacccctcactgtggcaatcagccagtaaggctcaaccccaccgagaatttggtattggcccctcccgcctgttccccagagaggaccaggtacaatgcagaagcatttggctcagctctctagggtgctattttgctgctat

SEQ ID NO: 377911 - DNA, 1247 bp, Homo sapiens
agagcttgttatcatccaaactaaaaccctcactaactcgatgtgtccctggatgactccctagtttatttcttcccttccctccactaagtcagttgtctccctatgcaccccaggagtagccattttccacagcggccaccacctctcctccagaaaatgggcggctcaaaatggagcccttcctctcctccggacctcaaatctgccacctgtctgctccattcatcattagttagctatagagcctgatttttctccaaactgtatgtatttaatccctgatttcttcctcacccccacgatgtgacatcctttcagcattttacctgctgggaaccagcgctctcttgtttctttttactgtgggtcacttgctagagtttgaaggaaaactttttgatgtgaacacatttcagttttttttccaatttacactggagagaggaatgaaggggagagggggctctggcccctgttacttcctgtttgtttttgttctggagaatgcagaccatctgtgtctctcagaagctattcttctacagccaccgtgctgaggctgatatttaatttcttagtttttccctcgtttctctctaatgtccttttcctcttccaaaaactcctaagcccctcattaaatctttcttcctgaattttcttatcttaatagtacctctggatacggttctgtccccattaaggccagaatttcaaattaagtaaatgataattggagagagaaaacaggagagaagggaacaaggaatcagtaagcaaacagaaaaaaaaaaagtgggttgactttttaaacatggagttcgctgattctcagagccacttcccatgtcctggcatccattgttcagctgatgtctcacctgttagatggaccttgtctttctcagaagaaacatctgctggatgttgggtctctctctgagttgcctgagaaggtccctccctaatttatttttcctgccacccagacttcgataaaggctatactttctcatgataatcaagatggttattttctagaactagtagagatattctccctcttctgagagctgcctgatgaatcccaacatatagtcaccctatatctctaaacaactaggtcctctttcagtagataattctataacttatgaaatttcaagtgtttcataagaagcatctttctgaggcacatcttcatttcagatgtcattgcagtttaggacacaatatttccctca

SEQ ID NO: 377912 - DNA, 547 bp, Homo sapiens
catttactcctcagcatgattctctgaggtagatactagtattgtacttacttattttgtaggagaaagccaaggctcacagaatctgagtatttactcaaagtcacagagctcataagtgccatagccaggttttgtccccaagctggtttgctggcaaagcccatgtactaatccacactgccatactacccccattgtgcattcacaaagtatttcatctcactttagctctgagaggtaagcagagaattaaccatactctccatttgacagtagaggaaacaagttaaagtgatttcaccaagggcacatggtgggacagctgagcagctggggctgggcatgaaatccagtgcttgttctacttaccacattgttgtttatagtctcagggccaccctgatgaactataataccctgggagtttgggactgaagtggcatcagttaactgttggattagaaaaaaaattctcatggtgcaatttccctgatctcaactgtggctgaattggaggaaggcagttgactgagccatgcccttg

SEQ ID NO: 377913 - DNA, 406 bp, Homo sapiens
agaatttcatgatgtttttcctacttcaaagaatatatttcctcccatttaaattaagtattttgttcaatcaacgaacacaggttttttaatattacagtgctagttactatggttaagatttaatactggccagatgcggtggctcacacctgtaatcccagcactttgggaggccgaggcgggtggatcacctgaggtcggaagttccagaccagcctgaccaacatggagaaaccctgtctctactaaaaatacaaaattagccgagcgtggtggcgcatgcctgtaatcccagctactcaggagcctgaggcaggagaatcacttgaacctgagaggtggaggttgcggtgagccgagatcgtgccattgcactccagcctgggcaacaagagtttgtctc

SEQ ID NO: 377914 - DNA, 447 bp, Homo sapiens
gtcagatttcactgacaagattgttagggcctggttgggtaggtgggtggggagggaagagttcaacaagtgagtccagatgcacgaggaggttaggaagaagttacgttgaatgttctagagtgggggacacaggaactgctctcccacaggtgaccagtgacctccaggggatctcattacccaaccctgatcctcatctgacttgacttctctgtggcatctaacacttcatttcctgtggcttctctgatctcacatccctacaatacatggcctttgtgtctggcttctttcacttagcatcgtgcttgaaggttcatccgtggtgtggcacgtgtcctttctatggcggaatcacagtacattgtatggatagatcaaacaatgtatagtctttcatctggttttttgttttgtttttgtttttgtgagacagggtctcac

SEQ ID NO: 377915 - DNA, 489 bp, Homo sapiens
  misc_feature (451)..(451): n is a, c, g, or t
gcggccgcgggctccgggggctcggctcagtggcagaagtgccgcctgctcctgcgcagggctgtggccgaggaacgcttccgcctggagttcttcgtgccgcccaaagtgagttaccccataatcccacctagcctggggggaccagaggaggcacctgggcagcagctgagggtgccagggactgcctttggggaccgcgtggtctaatctggttgacagggtgaagtatttggtgccaggaccctgggaggtgggcctgtcatgcctcttgaacaagtcaccccttcaaccccggttcttcctttgcgaggaagggtcctctggctacaccaaagggttctggggcactaattttttcttttcgtgtgtgtgtgtgtgtgtgtccgtgtgtgtgtgtgtgtgtgtgtgcgcgcgcgtgtgtgtgtgggtgacagagaccctgtctcanaataataataaaatagggcccatgtaaatccttttaaa

SEQ ID NO: 377916 - DNA, 304 bp, Homo sapiens
gcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccgggt

SEQ ID NO: 377917 - DNA, 410 bp, Homo sapiens
gaaaagcaaaacctattcatatgtactataacttggatgagtctcaaaatgattatgctgagtgaaaaaagtgctaaagagtacatgcactatgactgcatttatatgaaattccagaacaggcagaagtatccaacggagcaagtcacctatttattcactcaaactaatattttaaccttcaatcagagagctttcagtctatgcagaatgccttcataacctgaaaaaatcacttacacaattattcaaaaattctttactgagcagctgtgactgtgctttgggcacaagcactaaggctgcggcagctagcactgcgtgttgtcgaggagaccactttctaggggaggaagacaggaaaaacatcaaatgtgtaaacaataaaaatatactaaatgctcactatg

SEQ ID NO: 377918 - DNA, 608 bp, Homo sapiens
gatgatgctggcattcacactaggaagcttcctaagtactaaggcagttctcctaactgctgaactttcgctgagggccagtccaatcctacaaaggcttcccaagccattctctagcaagtgcactgtaagaacaaaaaatgaacaagacccactcctaccctccagatctagtgagggagaaactcagaagtctcagatggaagttggggggtgatcaaggaagattgcacaatggagatggcatttgaatcagtccttgaagaggtaaaatgtcagcagctggagggacatgcaggaaacagaaatgacctcaccttgagctgagatctgttccctgagtcagcccttggctccagaagccccagtcaccattcctcgaacatgttctagagttcctccaagatgcaggtcactctcctctggaaaagccctttttccttgtcccttgcactgtgtagtgcccagagataccatcagcaaagtatgtttggacaagacggtgggaaaactttgccactcaggagaagaatctagaaagtgcacccttatctgtaataacaagcactatccaatccaggtgtgcttcactctaaggaaaaaaaaaa

SEQ ID NO: 377919 - DNA, 508 bp, Homo sapiens
gagagaatctgtgggagatggcgcgggtataggggaaaaaatgaacaagacccactcctaccctccagatctagtgagggagaaactcagaagtctcagatggaagttggggggtgatcaaggaagattgcacaatggagatggcatttgaatcagtccttgaagaggtaaaatgtcagcagctggagggacatgcaggaaacagaaatgacctcaccttgagctgagatctgttccctgagtcagcccttggctccagaagccccagtcaccattcctcgaacatgttctagagttcctccaagatgcaggtcactctcctctggaaaagccctttttccttgtcccttgcactgtgtagtgcccagagataccatcagcaaagtatgtttggacaagacggtgggaaaactttgccactcaggagaagaatctagaaagtgcacccttatctgtaataacaagcactatccaatccaggtgtgcttcactctaaggaaaaaaaaaa

SEQ ID NO: 377920 - DNA, 418 bp, Homo sapiens
tttttagagatggggtctcattcttttgctgaggctggagagcagtggtgcgatcatggctcactgcagcctcaacctcccagactcaagcaatcctcctgtctcagcctcctgagtaacagctaggactacaggcacatgccaccaagcccggccttttaaaatttttggtagaggccaggtgtggtggctcatgcttgtaatcccagcactttgggaggtccaggcgagtggatcactcctggtcttaagtaatccgcccacctctgccatcaaagtttctgtttcttaagttggctgccgagtacacaggttttctttgtaaaataattatttaaattgttaatatgcattacttatatgcttttcatttacaatgtatttcacaagaaaaataaaacaaagcaaataagaaaac

SEQ ID NO: 377921 - DNA, 387 bp, Homo sapiens
gaaataaatatattttcagatgatgatttgccactattaaatatatttctggagagttgaaaacactgtcccccaaaataagaatactatgcatttaagtgataacatttgaagaattagtgtcgagagggaaagactaggtggataaatgaataaaagtcactaatttgaaggggacttgactcatttggagcgagttctaaaatgtttggtcacaatacagttcatgttgttttattgttaatgcttcatgtctaacctttgggcaaagtaccaaattgggcagtgttaaagaactagaaaacttaaatgaacttgtaactcaagctgtgcgtcacaaagaaccagaatataaatgatatttttagaagtcttccagtaatcttt

SEQ ID NO: 377922 - DNA, 3883 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377923 - DNA, 3774 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaattta

SEQ ID NO: 377924 - DNA, 3828 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaatgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377925 - DNA, 4301 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgaggtgtgtgtccggcgagtgcgaggggattggggagaccctgcccgggaagctcggggtccgggaatgaaagcgggcgcacctctttagcgagccctaaagcgtttgggagacgatcgttccgtccctgggagcggcacttggtggggctgggcggagggaggctctgcaagagaaacccggagtccgggaaacccagtagtttctggaggctgctcacattccttggcttatggcctccttcttccaacgtcaaagccagcaacattgcagcaatctgacttattttgttgtcatgtctcctgaccacatctggaagggttatctacttttgaagacacatccagataattcaggacaatctgtccattttgaggttcttcattgaatcatgtctgcaaagtcccttctgcaatctaagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377926 - DNA, 4102 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtttctggaggctgctcacattccttggcttatggcctccttcttccaacgtcaaagccagcaacattgcagcaatctgacttattttgttgtcatgtctcctgaccacatctggaagggttatctacttttgaagacacatccagataattcaggacaatctgtccattttgaggttcttcattgaatcatgtctgcaaagtcccttctgcaatctaagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377927 - DNA, 3717 bp, Homo sapiens
gcctttcttctgaggggagccttttatcctgctggtgagtttgggaaaaggaattggatcggggcatgcagcgtctccttatctgcaaacaggcctgccggtgggaatcatggtactgttccccagcaacacaacattaatttcagagggagatgctctgccactacaggagtgggtctgttaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377928 - DNA, 3829 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaatttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377929 - DNA, 4020 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtttctggaggctgctcacattccttggcttatggcctccttcttccaacgtcaaagccagcaacattgcagcaatctgacttattttgttgtcatgtctcctgaccacatctggaagggttatctacttttgaagacacatccagataattcaggacaatctgtccattttgaggttcttcattgaatcatgtctgcaaagtcccttctgcaatctaagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaaggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377930 - DNA, 3724 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377931 - DNA, 4041 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttatagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377932 - DNA, 3829 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagatactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377933 - DNA, 3656 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377934 - DNA, 3973 bp, Homo sapiens
tatattaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttatagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377935 - DNA, 2517 bp, Homo sapiens
atttgggatagatttctcaatctatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377936 - DNA, 873 bp, Homo sapiens
aaagaggcagggacaccaggctatgtgacacacaccagcggtcccatgacaggcaagacacagaaaacctcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaaaaa

SEQ ID NO: 377937 - DNA, 415 bp, Homo sapiens
agcccctcaggctaggtgttttacaagcacgtgtttaagcactggccttagtcgccctgaagggtggagtgaaaagatggtttgactatggaaataaaagccaccttgttctcaggtttttatagcctgctgaccttgtcctcaggatcttagagtctgtattagagtctgtagaccttatagttaactaatttaggaagctaagcaaacaccaagcaatataccttatcaagaaggcagactcataggcatgtagttccatacagaactagaagtagaggatgaaggggcaaaggtggaggtaagtcagggataatgttgcctttatctgcctatctatatgattcttcctaatttttaaaaagttgacttatttaaaataaactgtggatcttgctttcttgctttgactgga

SEQ ID NO: 377938 - DNA, 315 bp, Homo sapiens
attatacctttaaattctagggtacacatgtatacatatgtaactaacctgcacaatgtgcacatgtaccctaaaacttaaagtataataataataaaaataataatcatagaaaaataaaataaaattacaaaaaaaataaaaaatatagtaaatttaaaagagaaaaagatgaggtaaaggtaaatgtacagaatttaattactttttcttctataaaacccgagtcagtaccaagaagagtcaatttattagttttctaaaataaaaaaaaatcaaaatcaccaaaaaagagcaatatccaagaaaacattg

SEQ ID NO: 377939 - DNA, 463 bp, Homo sapiens
ttcttagtttattagcctataaatggccaagaaaacttaaggttcaataattagttataaatatgaaatatccccaatttttaagataaaaacaacttataaatgtatttgtctgtaaaaattgtgtatatttttacagaacatctatttatttttttatttttttattttttttatgtatacatatgtaactaacctgcacaatgtgcacatgtaccctaaaacttaaagtataataataataaaaataataatcatagaaaaataaaataaaattacaaaaaaaataaaaaatatagtaaatttaaaagagaaaaagatgaggtaaaggtaaatgtacagaatttaattactttttcttctataaaacccgagtcagtaccaagaagagtcaatttattagttttctaaaataaaaaaaaatcaaaatcaccaaaaaagagcaatatccaagaaaacattg

SEQ ID NO: 377940 - DNA, 283 bp, Homo sapiens
tgaatggaaagtgcaggtatgagcaaagacaccatggtggaggagggggtgaagcctgaaagtcctggttgttctctcagtgaggagacttgtagcctggggcaagttctcagccctgctcactggttgcctggatataaactcgatgctgttgggggagcatggtgggcatgagattggtctgtttagctgcatgggagaggggtgaggcctgtcactgctggctttcccccacttccctggtgacctaatatccggaatctacaagaaactcaaattagca

SEQ ID NO: 377941 - DNA, 1115 bp, Homo sapiens
tttttttttgctgtgatagactatccagcaccaagcagtacatggtagaaatctctatcaaacacatgcaggcaaatcactgttagtatagtacagccagatacagtatctattttaggggtggccttaattacatttttcccaaaaaatattttccaagatctaccctggggcactagctgcccttttctatcctagccacagcagtgaactctcctggctcctaagagctgatccagtagtgagactgggaagtgagaaactggtaggggggcccctttggtgtcacttgcagcaattcagaagatgacaactcatcatgggagacctcccgattcctaaactgctggactccacttggtgaataaccatggcagaggacaaacacacactgtgtcctggagaccacagtcttttgtttcttactcagtgttcacgtgggccacagaaagccggtctcctcatgagaaacagatacacaggacaaactacacaagttttccagaagaaaaagaacagagcttgttttaagaaatttgtacttttcatttcattacttaggaattacaagagactttgcagaagggtaaaaatggggagcgacatccctctgatagaaatgagatgcaaagaccacgtgagttacctgcccggtcccagtaaggagaaatcaacatctcatggaagaagtttcagtgtacactcctgcctttagtccaacatacaaaccattacaagaggatgcaatttatccctgttttcttttttaaagtatgaaagagagaattcacaaacactaaatctttctaaaggtataacatggtaaaggaatgaaagggtctgcataaaataatctagaaaaaacaagaggggaaggtgtggacatctatacccgggtattgtgggcacatttgagtggccccattgcattggccctggtagtggtatgggcgccgagagttaacagaataaccggacgctataacgttaaaccacaaacacgagaatacacgcctgaggcgacattttgtggcgcctgtaaagacctaaaatatatttactcacgctggaatctttacaagaacaaatttgggtagaacccctggtggtataca

SEQ ID NO: 377942 - DNA, 276 bp, Homo sapiens
aaaaaaaaaaaaaaaaagaagggaaggtagttgaatctataccagggatgggcaaatgactgcccatgcatggcctgttttgtatgggccgtgagttaagaataaagagctataaataaaacaaaaaaagaataagctgcagcgacatgtggcctgtaaagcctaaaatatttattagctggatctttacagaacaaatctgctgaatcctgttgtataccaatctggatatggatgatgcttgtgtcttctgaatgaaaattggcctaggacctc

SEQ ID NO: 377943 - DNA, 476 bp, Homo sapiens
cctcctccccttaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaac

SEQ ID NO: 377944 - DNA, 395 bp, Homo sapiens
tatagtagctgcactacgataatatttcggaccacccggatggtgattttcctgttctttaactggctctgggaccttggtcaagttctttaacgttggagactctggtttcgcgtgtgtaaaatggtcacaggaatggtatttatctcccttgagattgttgaggggattgcatggaagacttgtaaaaatatgcatgctaaaaacatgttgttcagtaaatacctgctactgttattgttactttattattaagttattcggttgactctaccaatgacttatacttcctgtcaacttttattatagcagtaatgaagcattgcactgattcagattttgtgaaacctcacatttaggctgcactccaccagcccaagaaaggggcttactga

SEQ ID NO: 377945 - DNA, 719 bp, Homo sapiens
agcaagactccatctcaaaaaaaaaaaaaaaaaaaaaagagtaatgaactcagccagcatggtggcacctgtctgtagtcccagctactcaggaggctgaggcaggaggattgcttgagcccagcagttcgaggttacagtgagcattgatcacaccactgcactccagcctggacaacagagtgagaccccatctctttgggaaaataaagagaaagagggtagtaaactcaacatttgacttagcttttgctgttaggtatttttcaaattcagaaggagaaattcagtagagagctattaccaaagacttaaaaacttaagcacagtttttgttcttacaggagtaggtagacaaaaaaattagatttcaaggccagccaaatgggaatgacaaagggaaatattcgaggccttcggttgagacctcaaaagaattatgtcctacaaataaaggttgaccagaagttatcagctttaaatctaacttcaaaactttgattgaatgaggtgatcagcccttattctagttacctgccagaagaaacttagcctctatactatttgaaacatagtatcctgcattccatcaaaataccaggcatgaccaggcacagtggctcatacctgtaatcctagcactttgggaaaccaaggtgggaggattactggaggccaagagttcaagaccaacctggccaacatagtgagaccctgtc

SEQ ID NO: 377946 - DNA, 416 bp, Homo sapiens
  misc_feature (302)..(302): n is a, c, g, or t
  misc_feature (371)..(371): n is a, c, g, or t
  misc_feature (395)..(395): n is a, c, g, or t
ctgaaatgcccttagctcgggtagcctcagggttcacttcctcacccctttctggtgtttctatgtccccttctcagtgaggctgtccctaatcacactctatgaagtttgtacccttccccttcagtattatctacctcttccttgctttattttcaatggcatttaccatcatctgccatactatagatatcactggttgcttggtttctgtctcccatacactagaaggtcagttccacagggtaggaggttttgctcttattcacttgctggcataaccccagggcttagccagggtnctcttacaagagggggtagccgaaggttttatgggttgggataaaagggaagggggatggagggagggnttctttttgcaggggacgtgaggntttttgaatgggcagaaacct

SEQ ID NO: 377947 - DNA, 922 bp, Homo sapiens
ctgaaatgcccttagctcgggtagcctcagggttcacttcctcacccctttctggtgtttctatgtccccttctcagtgaggctgtccctaatcacactctatgaagtttgtacccttccccttcagtattatctacctcttccttgctttattttcaatggcatttaccatcatctgccatactatagatatcactggttgcttggtttctgtctcccatacactagaaggtcagttccatgaggtcagggatttttgcctgccttgtttactgctatatcccagccgctagaacaatccctagtacacagtagacactcaataagtacttactgagtgaatgaaggtccactcctctgtttggaccaagacctgctcagctatttagtcagctgctttgaccagaaaaaaacagtggatccagagacagagttggtcatgtcaaaggcacagctgccctgactgccaagaacttgtggttgtcttgaatccacaatcttttctctggcattgggttccccaacctgatcaattgagttgggagcaatggattcaagtcaacagtcattcttacactggacagaactcgagctgagccgggcactgtaatggggctggttagaaagataagtttggtgactgggcacggtggcgcactcctgtaatcacagcactttgagaggctgaggcaggtagatcccttgaggccaggagtctgagaccagcctggccaacatggcgaaaccctgtctctaccaaaaatacaaaaagttagccagttgtggtggcacacacttataatcccagctacttggaagtctgaggcaggagaatcgcttgaacctgggaggcggaggttgcagtgagccaagatcacgtcattgtcctccagcctgggtgacagagcgagactccatctca

SEQ ID NO: 377948 - DNA, 138 bp, Homo sapiens
acaacctggcctggcctctcccatccctgttccaggcatgctttcttgtgtggatcactcactcccaccctcagaggggccaggcatttccacacctctccacttttgtctcaaataaaaatattctggaattagata

SEQ ID NO: 377949 - DNA, 685 bp, Homo sapiens
acaatttgaaaaaacacaaactgcgttgcctagaaatatttttaaacattttaaaaggtatgaatgcataaaatatatgtatatactagtctattttatcatttgctactacaaaatatgcacaaatctattataaaaagctaaattttctcaaaatttacacacatatacagtacatggtgccattcacagtccagagaaatgtaaacaaatgtaaagatgcaaggttaaatcatagccacataaaaccaactggagtacgtactgtactgcaatcattttgtagctgcctcctactgctgcggcagtgcgcgcagatgttgtgaatatccactcaaaacgctatgtgatgctaatcatctctgcatgagcagttcaactctccagtaaatttcatgtggcagaaaaaagtactctctcgagattcttaagtatttttcatcatgtttagtgcaccataaacctcatataataccatgggacccatatgaagtgccactagtgatgctggaagtgttctcaagaagtagaagtcatgacattacaagaaaaagctgaattgcttgatatgtatcaaagattgaggtctgtggctgtggatgcccctcatttcagtcccaggattctttctgtaaacagacaatgtaaacttaacggaatcaataaatacagtaatgtaaatgta

SEQ ID NO: 377950 - DNA, 4047 bp, Homo sapiens
ggactctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377951 - DNA, 4043 bp, Homo sapiens
aggaaccgcggaggaagtgaaggccggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377952 - DNA, 1392 bp, Homo sapiens
aggaaccgcggaggaagtgaaggccggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagatt

SEQ ID NO: 377953 - DNA, 4252 bp, Homo sapiens
aggaaccgcggaggaagtgaaggccggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggggcatggtatggtggctcacacctgtatttccagctgctcaggagaccgaggctgaagcacgaagatcgcttgagctcaggcattaaagaccagcctgggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377954 - DNA, 3763 bp, Homo sapiens
aggaaccgcggaggaagtgaaggccggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcatggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377955 - DNA, 3989 bp, Homo sapiens
aggaaccgcggaggaagtgaaggccggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataagagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377956 - DNA, 3205 bp, Homo sapiens
ctgcgttcagaggtcccactcgaccgagtccatgtctcctgacagccttattgcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377957 - DNA, 3551 bp, Homo sapiens
aggaaccgcggaggaagtgaaggccggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccaggtaaactatgatcagtataaagacataaaagtgttatacatagtggtcagaaaaatacaggaagttatttggaacataaacattggttcagaaagctaatgccaattcatttttcagtggccacagtcatgggttctaacatttcacaatgttaattgcaagtgtgtttataattcttttcatatttgtaaaagtatttgcattttttttttaatttacaaggctttgagggattgtaaattcgaactggccaaaagaatactttggacatgtcttaaatatttttagcattgtgaaatgttttaattgcttctttttcctaacttgtccagaattactccgctagttagtggcagagaaaaacaaaagccagttctgactcctagtttactatgttcaaaatttgtttcttttaagccatattttataagttatgtctattttgccaaatgatttttgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377958 - DNA, 1184 bp, Homo sapiens
ggactctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaagggtctcactttctcatccaggctggagtgcagtggcacaatctcagctcactgcagcctcgacctcctgggctcaagcagtctgccttcctctgcctcccagagtgctaggattacaggcaatgagccacca

SEQ ID NO: 377959 - DNA, 679 bp, Homo sapiens
ggagacaagatcttgctctgttgcccaggctggagtacagttgtaggattacagttcactccagcctcaatctcctaggctcaagcaatcctcccatctcagcttcccaaatagctacgactacaggtgcatgcctccatgccctgctaatttttgtattttttgtagagatggggttttactatgttccctaggctaatcttgaactcctgagctcaagcaatccacccgcctcggcctcccaaagggctgggattacaggcgtgagctatcatgcctggcctaatgtattttttaaaagttgaatctaaaaagaatttaaaacaaatataaatcagctcagtaaggatggatatttttgtacatttaaaactattattttaggccgggagtggtggctcacacctgtaatcccagcattttgggaagccgaggcagggggatcatctgaggtcaggaagttcgagatcagcctggccaacatggtgaaacccctacctctactaaaaatacaaaaattagctgggtgtggtggtgggtgtctgtaatcccagctacttgagaggctgaggcaagagaatcacttgaaactggaaggcgggggttgcagtgagccgagattgcaccattgcactccagcctgggtgacagagcaagactccgtctcaaaaacaaaaaa

SEQ ID NO: 377960 - DNA, 1396 bp, Homo sapiens
ggactctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagatt

SEQ ID NO: 377961 - DNA, 2569 bp, Homo sapiens
aggaaccgcggaggaagtgaaggccggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggccgagattgcaccattgcactccagcctgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377962 - DNA, 3921 bp, Homo sapiens
agataccgtgtcagttgcgtgtcttcattcttcacaacttttcacgttattgtcctcttacggagacgaggaaaccgtagcttagataattttcctccagaattacaaagatagttaagtgacataggtggggttcggcctggtcagccgtgttcagcctcccagcccctttccacctctcagcgcaggtggagctcgccggacctcgccagcactgatgggagttttactgtctaatcccttcaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377963 - DNA, 3783 bp, Homo sapiens
tgaaccttcaaggaatagcatacccttttctgcagcaatttagttacttgctgtgttgatccatatagattctctaccctgaaattgtacatatataaaatcaacaagctatttctgaggtgtgtatgacaacctgaaaatgattccaaagaattatgttacattttgttctggttcccaattttcttgtagttttggaattctctacacacaactgtcatcagggaagatgtcatccctttttatgaggagatacatatatgtgagaaattgggcggaataaattattcttgagaaattttatgtatcatttcgaggagaagctgaacccagaactataaagctaaggccaagtatgacttctttccattgcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctgaaaaat

SEQ ID NO: 377964 - DNA, 1415 bp, Homo sapiens
ggactctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgatgcaccataaacctcatataataccatgggacccatatgaagtgccactagtgatgctggaagtgttctcaagaagtagaagtcatgacattacaagaaaaagctgaattgcttgatatgtatcaaagattgaggtctgtggctgtggatgcccctcatttcagtcccaggattctttctgtaaacagacaatgtaaacttaacggaatcaataaatacagtaatgtaaatgta

SEQ ID NO: 377965 - DNA, 797 bp, Homo sapiens
aggaaccgcggaggaagtgaaggccggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggggcatggtatggtggctcacacctgtatttccagctgctcaggagaccgaggctgaagcacgaagatcgcttgagctcaggcattaaagaccagcctgggtaatcatagtgagacccccgtatcaataaaaaatcataataaaagttgaaactaatgttgc

SEQ ID NO: 377966 - DNA, 288 bp, Homo sapiens
gcttgaacataattggaaacaaagcagacatcaaaatgttatgttgattccagcagcaaattaagtattatctattcttaaaaataatttcaagactaaaagtaaaaatgtcaaaaattcatttgcggcgggcggatcatgaggtcaggagatcgagatcatcctggctcacacagtgaaaccccatctctactaaaaatacaaaaaattagccgggcgtggagcttgcagtgagccaagatcgtgccactgcactccagcctgggcaacagagcaagactccgtctc

SEQ ID NO: 377967 - DNA, 457 bp, Homo sapiens
agaaagagcgtgggccctggacaaggacatgagccccaggaagggagagccagcctgggccactggacatcctgcagaggatggcctgcaggggcaaggtgacttcacagggcttaacctccagctgagcagggctgaagcagcaaacttaagtgactagtggagtgcagagaatgcacacactccaccatggcaagttcagtcacctgttccccacagtgcctctcaagagccccacaacagccctcattatagaaagtcagctttggatatctgcccggctagaggcaatcacacccgactgtacctcttctccctccaccgcaagtctcagccagcaagaggaaggaaaagctggccaagtagacaaagaaagtggaccacattcccatccctgggtgcagataatcagcctcaagcccaggatggacagggagcaagaagttttacttaaaat

SEQ ID NO: 377968 - DNA, 423 bp, Homo sapiens
accacgtgaggatcttgacttgtggagaatggggagctgtgggcctctcagtaaaaaccagtttgctgataagcatttattcgggagtaatggagaaggaagtaagagagagaagttgagaggcgctgagtcacctggaaatccactaattccaccgaattccactcgcccaccctgctggtcatagctgggactgcactcagagggttaagaactggagcctagggagcttcagagctgtggctctgaaaaatctcttcccagctctcagctttgctgtccccctcagcaaagggaagggctggccaggcacggtggatcatgcctataatcccagcactttgggagccaaggcgggaggatggcttgaggccaggagtttgagactagcctgggcaacgtagcaagaccccatctctacaa

SEQ ID NO: 377969 - DNA, 849 bp, Homo sapiens
  misc_feature (22)..(22): n is a, c, g, or t
tcggctaggtacgaggctgggntggtgctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcgtaacccgggactttcgggtttacccttcaaacgggacgtgataatggccgggtccaatgtgcgggatgaactggccaatggggggggaaagccctgtgaggttcggcacgcaccggggaaacgctccggaaaag

SEQ ID NO: 377970 - DNA, 422 bp, Homo sapiens
gcgaacttaccccttggggagccacagggatgcatgcctcactggccaccaccccgctgaggggttccagggctgctctgtggcctcacttgcttttcttcatccccaccaggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttata

SEQ ID NO: 377971 - DNA, 732 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgagtagctgaggagccattttgggccacaggtttggcacacagaggctttagctaagcaggcaggctggacacgtgggcctcctctgtcttgctcttcctctcatctcctcttgtgttcctggttctcatggcagccgggctgcagttcccttggccctttcaactgaaactgcctttccagaggccactcacaatcccacccccattgctacctccagggtggttcacctctgacttccttacaacccctcagcaaggaaacgcccgcttaggatttcccaactcaggatttctcctcttccttccactcctggttcttctccaagtccatggttcttcgctctcccatggattcttccttgtctttcttggttgacccttccagctctgtccctctctagttccctgagtcctggtccattt

SEQ ID NO: 377972 - DNA, 631 bp, Homo sapiens
ttgcaatctatgaggaaaggttattggaattctgttcggtgtttaagccagcaatgccaagatctgttgtgggtacggcttgtatctattgactgccctttttgagcaaaatgaagatgtttttataaagcttggatgccaatgagagttattttatggtaaccacagtgcaaggcaactgtcagcgcaatgggggagaagaggttagtgtagctgaggagccattttgggccacaggtttggcacacagaggctttagctaagcaggcaggctggacacgtgggcctcctctgtcttgctcttcctctcatctcctcttgtgttcctggttctcatggcagccgggctgcagttcccttggccctttcaactgaaactgcctttccagaggccactcacaatcccacccccattgctacctccagggtggttcacctctgacttccttacaacccctcagcaaggaaacgcccgcttaggatttcccaactcaggatttctcctcttccttccactcctggttcttctccaagtccatggttcttcgctctcccatggattcttccttgtctttcttggttgacccttccagctctgtccctctctagttccctgagtcctggtccattt

SEQ ID NO: 377973 - DNA, 3871 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 377974 - DNA, 5416 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 377975 - DNA, 4731 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaatta

SEQ ID NO: 377976 - DNA, 5609 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacagtaaatattgttaatagcgtatctggtttggaaccgtgcagaaggcgttagtcctctgcacttagtgcagcttgtttcccttttggtccacttaactagaattggacgttttcttcaatacttgactgtagtttttcgctctgtcacctaagccattagactcttctaaaatcagcgtctcttttggaaatagatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 377977 - DNA, 4260 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggggcaaaaagaagcaagctgagaatataatgaagagacttttgggggccgccccgggccccctgaaaagcacctttgagaaaccacttggtggggacgcgcgcgggggaccccaaagagagtcaagtggtgcactagcgtggtccgacaaggcggttgcccaagagggataacaccgggcgaacgacaaagagaacaggggcccggggaagactcgccccgcccggatataaaaaaaaaggcgcccgggagggaggaacccacgagagcgctccgtcggagcaagcagccccaatagggggaggccccgggagagggcacaataggaggggagcgacaatcaaccaaggggaggcacacaacaggaggcagccccatactcagtatagccg

SEQ ID NO: 377978 - DNA, 3471 bp, Homo sapiens
cgagggggaaaacccccataggtaggtcgaggctggtgtgtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 377979 - DNA, 5353 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgatgttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 377980 - DNA, 3711 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttata

SEQ ID NO: 377981 - DNA, 4215 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtgtagctgaggagccattttgggccacaggtttggcacacagaggctttagctaagcaggcaggctggacacgtgggcctcctctgtcttgctcttcctctcatctcctcttgtgttcctggttctcatggcagccgggctgcagttcccttggccctttcaactgaaactgcctttccagaggccactcacaatcccacccccattgctacctccagggtggttcacctctgacttccttacaacccctcagcaaggaaacgcccgcttaggatttcccaactcaggatttctcctcttccttccactcctggttcttctccaagtccatggttcttcgctctcccatggattcttccttgtctttcttggttgacccttccagctctgtccctctctagttccctgagtcctggtccattt

SEQ ID NO: 377982 - DNA, 4389 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccagggtgggtcctccctcccgtcgtcttgctcttgagcccacaggctgagcaggggcacagagcacagagctgtccttgtgtggccagcttgggaacgggggcaggactggccgccttcccagccccccagtgtcctcccagcctggctcctggcagccgagtttggagtgagtggagcctgtctggccagcgtccaaggcctgcagcagcctgtcttccccagccaccagcccctgacactgcctggggatgttcccacaggatccataaaggcctctgtggaaggcgggcagtggcgggctctgggtgacggtggttcagccacctttgtctgtcgacttctagctgggcagctccttctctgtggtcagggtagccctgtggctgacgctgcagtcattgggctgaagctgttccctgagtccccaaagttgccctgcatctgcgcctctggctaggctgccccaaactacctggggtagtggggggcagctgtggtggtgacacagctacccctgcagaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 377983 - DNA, 3776 bp, Homo sapiens
gtcttgcggggcccagcggctctgattccgtaccccccaccccaagggctggaggctggcagtaggcgtagtcagaggacgccacccgagccacgcgagggagaagagtggagatagacaagacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 377984 - DNA, 3311 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 377985 - DNA, 3345 bp, Homo sapiens
actctagaggatctgatggagaccaggctgaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagagacagggtctcactatattgcccagactggtcttgagctcctgggctcaagcatccttctgcctcagcctcccagagtgttggcattacaggcattaggtggttcttcaaaaaagtctgcatgcctatttagatgctagatctctcaccctttctagctctacaagtatagagggaaaattcgagacataaatagcctcacctttgtagaattgagctccctgaaggcccacagtctgcctctggtcttgtatctggaccagcattcctttctcattgtgctgagagttgggaaggccctgggtgacccctcgggaccatttcctgagaaggtgttctgtaaatgacaggcttcttgcatcaaggccacttttgttaacctcccgtcagtatttggttggtcctaggattagggccagtgtcctcactgtgagtgaattcacagatgagggagttggggtggggaatgagagcaagaacatgggggccagctggggacagttgagaacaatgatgcaactttctcctctcttcctttgtggtagcagaccttttatgctttcttgaaagcacttattttatcttttcattacttaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 377986 - DNA, 2585 bp, Homo sapiens
catagctgactctagaggataaacgccaacgcaccaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 377987 - DNA, 3868 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggcaagtatttcttgagcccaattgtggacgttcagttaggggtggcagttaacgctgacctctgcagttgcgttggtggaaatcacccagctgggatccatgcgcgtcattcccagactcagtggggtgtgcctccattgcaaagacagttgcacagaagctcaacacagacccagtgttgctccagtttttcaagtctcaggggtaaccctcaagccgctgtggtgcagagggttatgcgtgtttcacaattaagccacgtttttcctccttccccttgtatcttctgataacattagctgtagtaaaaaggcgcagttcccatagaaaagccaaacagaggaaggatatgattccatttgaacgatgaactgaaactggaaggggtgactcctgattttgtatttgacagattgagtcacttctgttccatctagccaacatttgggctgtagaaagaagcccctgaattgattgtttatttcagagagatgggcatgattctcactactttgccctgtagtcgcttggaggacaaatggcttttggagccatttggttcccaaactttctttagttttaataaaacaattattaaacagtgagaccctaatctattacctaataagagtaagtgaggaaaacgccactatcagctgaatgtgaattccttgtgggaaaggtttatgcaactttcggaggcccagtctgtacatctctgtgcccaaatgtggccatttccactttgtccagcagagccctttaatcttatgcttcaaggggaccccctctccgtgccttgctccggtctctgtttctgatatttcagatcctctttaaaaaaaaaaaa

SEQ ID NO: 377988 - DNA, 3005 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaaccatctgtcaaggatcgaactcgcctgcgctgagacctgcaaggatcctctagatac

SEQ ID NO: 377989 - DNA, 3675 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 377990 - DNA, 1961 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaatttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 377991 - DNA, 1798 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaattttttaaatcctagggctctcatgcattccttgtgggcctcaattagatgtccacagtgttcttctcctttctcgatgatacacgcatcgcgcgccttcttggtctccgggcaagcgcagcagggcttcagcggcttcttctcctgagactcaggcggggcagggtttgagtcaaccagacccggcatctttcgcgccacaagcagctatgagcggagacagccaaatctatgccagcctcggaaacgccaatcgccgcgtgtaaaattgacgggaccacccaatcgaacatc

SEQ ID NO: 377992 - DNA, 834 bp, Homo sapiens
tttacacatttttgggcccccctgacaatttccgggagctggtgcacattaagccgatggctcatggcgacctgtgactggctacactacgtgtagggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 377993 - DNA, 858 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccaggtcagtgagcgccacccaaggcctggtggaagagaaaaggacccagtatctgccttgacctacctgggaacccccatagcacacccctgccccaagcagttctgtagtgggctcccaatccctgatgccaggacagtgcccacgtaggagctttcctgcttgacagagttggagagtgccattgtggtttttgttaatataaaagcaatacca

SEQ ID NO: 377994 - DNA, 433 bp, Homo sapiens
cttcatgcaacatgatgttcaggagctttgtcgagtggtaagtttcaagcaatacttgtatatttcttacaatgaatattttgaagcatggtcagaagttattaccaagtaaaacctcagacctaattcagaaaatgcccatctttgtttaggatcagacttaggctacaaaaaggcagcagatgtctagttataaaggctggtaagaattacttgaatagggatttgaaggtgaagtgaggaagcttgaattttaatactagcaggcagtaggcttttaatttgttaaattggtatatatacaggagttattaatccagaaaccaaagactggctttgttggctgtcccgttggtcctgagtcactgtacagtggtgacttctgttgttactccagtgtccagacccctcctgtgcagcgaggttctcattg

SEQ ID NO: 377995 - DNA, 571 bp, Homo sapiens
tctaccaccgcgttgatgtcattttctgtgataaaacaatccctaatgatcctggatttgtggttacgttatcaaatagaatgaattattttcaggtatttaataaatgctcctttcctcttcagatcccactccagaaagacaaatttctttcttaaaatgcttgttgaagaagctatctcatggttttggttcagaaggggctatgcccgaggaaatctcccactgatggattcaggctctctgccttgggagctagaataatcgccatcagaaaagaacctgtagacctcaccattaaaagtgaaaaccctttccaaagttatcttcatcagatatgctactcccatggtgattcattaaggaataatatagtttattcctgtttaataaatttctagggaatttaaattcaggctgctcatggcacattttaagtaattaagcatgaagtttatgaccaagtttcaatttttccccaaaatgtgaaccttcctttctgtgtctgttgcaaagacagttgcacagaggctcaacacagatccaatgttgctgcagtttttcaagtctc

SEQ ID NO: 377996 - DNA, 4014 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttca

SEQ ID NO: 377997 - DNA, 522 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacgacatggcaaccacagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatggcatgtttctgtatgtttaatgacttgttggggta

SEQ ID NO: 377998 - DNA, 5247 bp, Homo sapiens
attctatgcagtcactctgatgtgggtgagagaacctcccccatcccccagcagaggccactgcagagccatgcagagatggctgggaaccacaggcttgggctcgaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 377999 - DNA, 4945 bp, Homo sapiens
gagctccgacccacaccacctgattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 378000 - DNA, 4956 bp, Homo sapiens
ccttgcgtgtgataagtgtaatatgtaaccaaactctaccatgaggcatgttgggtgtgagcatgcaggtctccgttaagtgtctgttggtgctgggcttgatcagtgacaggagtgccactgtcagcaggcaggtgcttcgagggctgtgcgaatgtgggggttgcatttgcaccagttcacacactggagcaagcagaagggaatcggtgaccattgaaggatgctgtgtgataagtgttcctggcctcggtttccttaaggctgaccttgagtcagattgcttcacacacactgcaggagcaatggggtatctgcaagatcccctcaaccttgaactgatctttcaggtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 378001 - DNA, 4164 bp, Homo sapiens
cgtaagtaagtccaaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 378002 - DNA, 5509 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcaggtatgagtccaaattaatgtaactatgggtcataaagagaaggctcggggttttggtgacggtatctgatgtgaatctttcttttcttaatagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 378003 - DNA, 5168 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtgttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 378004 - DNA, 5348 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcagttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 378005 - DNA, 4019 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccgtgagtgcagcaaaaacagccccagcggcactggaatctaggggtggaggtggggtggggcagacaagtagtgttagatgggccaggggtggggaccctccttgcaggatggctcatggcgacctgtgactggctacactacgtgtagggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 378006 - DNA, 4026 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactgtatccctttgtggagaggcaggcagttgggaggtggatagcatgggaggtcaagccagcggcttctctcctgggcacccctgggtgggcatggcccaggtggcccgggttgcccgttgattctgttgttgcctccttgacttgaggccctgcagacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 378007 - DNA, 3761 bp, Homo sapiens
ctttgggccatggcagccgaaggtgctgtgtgcggcttcgtctatctggagggcactgcctgggcggtccctgaggacaccgaacccttggcatcctgcacattgggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 378008 - DNA, 3683 bp, Homo sapiens
tacaggatgggggacaccctgagccccggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 378009 - DNA, 3662 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaagggttctcccccccccgggggctggtgtgggtttcagactaagaaacaagtggtctggggctgggaggggcagccccaggttcaagtgccagctcctctctctccactggccgacctgtggaaccaggagcaatagcattccataacctacgagttcttaacaggtccttacatcctttgtaacctgtgagatcttcaaggagagaagcttggatatgtgtgcagggtgattgagactcagggttgtgagggcagtg

SEQ ID NO: 378010 - DNA, 2592 bp, Homo sapiens
gtcatagctgcttcctgagcataaaagccgggccagtgaatcgtgaatgttgtgtttagaatgtttcttggtaaaaaacacttttaggaagacgaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaaaaaaacg

SEQ ID NO: 378011 - DNA, 4271 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgagcccctctgcactcccccatggcctggctgctcccaggccctcgcccggctggggagagagatagggaacacagatgcagcacgtcctgcccttattggcccccggggccaggcggccatccatgaggagctactgagaagtgccctgggcctggcactcacctgggcctggagctgcctggacccagaatcttcatggcctgtttagggctcatccaaaggagagaggcctggtgaggtggaatcagggagactggtgacacccatagggatagacacaggggcggcctgagcccccaaggcgggccctgggggtgagggaggccaggctggggtctggggcccaaggtgtggaatgggggtgacaggacccagcttccttcctggtgcacacaggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctggg

SEQ ID NO: 378012 - DNA, 2744 bp, Homo sapiens
  misc_feature (2701)..(2701): n is a, c, g, or t
  misc_feature (2713)..(2713): n is a, c, g, or t
  misc_feature (2738)..(2738): n is a, c, g, or t
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggaaatttaatttttcaagggttggcaaaaggaccaaggnttggcacaagangggcttcaaacaacaagggattccnaaatgg

SEQ ID NO: 378013 - DNA, 2202 bp, Homo sapiens
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgagcccctctgcactcccccatggcctggctgctcccaggccctcgcccggctggggagagagatagggaacacagatgcagcacgtcctgcccttattggcccccggggccaggcggccatccatgaggagctactgagaagtgccctgggcctggcactcacctgggcctggagctgcctggacccagaatcttcatggcctgtttagggctcatccaaaggagagaggcctggtgaggtggaatcagggagactggtgacagggggatggggaaaggcttcctgaaccccagcacctccccgtggctgcgtctggtgttggaggtccagctgggagatgtggcaggctgcatggggagatgtggcctgacagggctcagcccacccctgcatttaggagcaagcctggcacctatgccaaagctataaggtgaccaatatgtccacacctccctgaggcccccagag

SEQ ID NO: 378014 - DNA, 1797 bp, Homo sapiens
actctagaggatctgatggagaccaggctgaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagagacagggtctcactatattgcccagactggtcttgagctcctgggctcaagcatccttctgcctcagcctcccagagtgttggcattacaggcattaggtggttcttcaaaaaagtctgcatgcctatttagatgctagatctctcaccctttctagctctacaagtatagagggaaaattcgagacataaatagcctcacctttgtagaattgagctccctgaaggcccacagtctgcctctggtcttgtatctggaccagcattcctttctcattgtgctgagagttgggaaggccctgggtgacccctcgggaccatttcctgagaaggtgttctgtaaatgacaggcttcttgcatcaaggccacttttgttaacctcccgtcagtatttggttggtcctaggattagggccagtgtcctcactgtgagtgaattcacagatgagggagttggggtggggaatgagagcaagaacatgggggccagctggggacagttgagaacaatgatgcaactttctcctctcttcctttgtggtagcagaccttttatgctttcttgaaagcacttattttatcttttcattacttaggaaataacactatatccagacaagcatgggtgtgtccgggacctgttagaagaatgtaaaaaggccgtggagcttggggagaaagcatcagggaaacttaggcaagtatttcttgagcccaattgtggacgttcagttaggggtggcagttaacgctgacctctgcagttgcgttggtggaaatcacccagctgggatccatgcgcgtcattcccagactcagtggggtgtgcctccattgcaaagacagttgcacagaagctcaacacagacccagtgttgctccagtttttcaagtctcaggggtaaccctcaagccgctgtggtgcagagggttatgcgtgtttcacaattaagccacgtttttcctccttccccttgtatcttctgataacattagctgtagtaaaaaggcgcagttcccatagaaaagccaaacagaggaaggatatgattccatttgaacgatgaactgaaactggaaggggtgactcctgattttgtatttgacagattgagtcacttctgttccatctagccaacatttgggctgtagaaagaagcccctgaattgattgtttatttcagagagatgggcatgattctcactactttgccctgtagtcgcttggaggacaaatggcttttggagccatttggttcccaaactttctttagttttaataaaacaattattaaacagtgagaccctaatctattacctaataagagtaagtgaggaaaacgccactatcagctgaatgtgaattccttgtgggaaaggtttatgcaactttcggaggcccagtctgtacatctctgtgcccaaatgtggccatttccactttgtccagcagagccctttaatcttatgcttcaaggggaccccctctccgtgccttgctccggtctctgtttctgatatttcagatcctctttaaaaaaaaaaaa

SEQ ID NO: 378015 - DNA, 607 bp, Homo sapiens
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatggtaagtgcctgtggttcaccgcctcgcagtgggcggaaaccttgtcagaaaacaggttcagatccatgcttggtacttcttgggtacatccttgggtacttctgagcgtagctagttttcaggaggctgtaactgaggaaaatcctgtttgggttttgagtttcaagattgcctacaccattgccaggtaagtagagtctccccggatacagctcccggataca

SEQ ID NO: 378016 - DNA, 4124 bp, Homo sapiens
ggggaagggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagaacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagttttttttttctcttcttcttcttcttttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagatttcttagtgagtccttcatttttatgctgttctttcaaactttgtcctacttattgatattctaataagagtagatcactaaccctattaataatgtctaagtatttcaccccacttgaagattaagaaaaagtcttgcattaaattatgcaattcaaaataaccc

SEQ ID NO: 378017 - DNA, 809 bp, Homo sapiens
tatttaattaacatcatcattattgttaaatattatttatcggtcctcaaaccttgtaattttctcaatgttttgtattagaaaagatgtattacttgaataatagctatttaataattgtattggtgagactatgaatataatagtaccattcaggccagatgcagtagttcatgcctgtaatctgaggattttcggaggctgaggcgggcagatcacttgaggtcaggagttcgagaccagcctggccaacatggtgaaactccgtctctaccacaaaatacaaaaattagctgggcatgttggcgtgcgcttgtagtctcagcaactcagtaggctgaggcaggagaatcgctcgaacctgggaggtggaggttttactgagcagagatcaccactgcattccagtctgggctggtgacagagtgagaccctgtctccaaaaaaaaaaaaaaaaaaaaaaaaaaaaaaaaaaaaaaaaaaaaaaaaaaaaaaaaaaaaaaaaagtgattgtaccagtcaggtgtacatgttctcttaaaacagtttttagatattacataaattcagaggttgggggaatggagatttgagtttcttcttagaatttatcagtaatttgtttttcctctcttcctacaatagcggccctgttctgtcattagctattagttctaatggagaacagtgttttagtggtggtattgatgcaaccatccagtggtggaatatgccgagtcccagtgtagatccatatgatacatatggtaagtaaaatgatcaaaatgtattttttttaagtgaatgga

SEQ ID NO: 378018 - DNA, 3931 bp, Homo sapiens
ggcctcatcgctttatacttcttactaagtcatttttcagtttcctatgtatggttaagggaaaatgtaaataaatgcatcttttaaatttttaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggataaagatgacctctccccaactgctgaggtttgggatgtagaccagggactaataagtaaactgaaggaacagtacaagaaggaacgaaaggggaagaaaggggtgaagagggccaacaggacaaaactctacgacatgatagctgatctgggagatgatgagctgccccacatcccttcaggaatcattaatcagtctaggtcagcctctactagaatgactgatcatgaaggtgcaagagcagaggaagctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagttttttttttctcttcttcttcttcttttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaatatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagatttcttagtgagtccttcatttttatgctgttctttcaaactttgtcctacttattgatattctaataagagtagatcactaaccctattaataatgtctaagtatttcaccccacttgaagattaagaaaaagtcttgcattaaattatgcaattcaaaataaccc

SEQ ID NO: 378019 - DNA, 2929 bp, Homo sapiens
atttccactggacattttagccaacagttttaaatatatgtgttaaacacaccaaaaagaaacgaacaaacactccacatgccttccagtttactacttttaccactaaatattgtgctctttccttttagttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagttttttttttctcttcttcttcttcttttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagatttcttagtgagtccttcatttttatgctgttctttcaaactttgtcctacttattgatattctaataagagtagatcactaaccctattaataatgtctaagtatttcaccccacttgaagattaagaaaaagtcttgcattaaattatgcaattcaaaataaccc

SEQ ID NO: 378020 - DNA, 3169 bp, Homo sapiens
tatttaattaacatcatcattattgttaaatattatttatcggtcctcaaaccttgtaattttctcaatgttttgtattagaaaagatgtattacttgaataatagctatttaataattgtattggtgagactatgaatataatagtaccattcaggccagatgcagtagttcatgcctgtaatctgaggattttcggaggctgaggcgggcagatcacttgaggtcaggagttcgagaccagcctggccaacatggtgaaactccgtctctaccacaaaatacaaaaattagctgggcatgttggcgtgcgcttgtagtctcagcaactcagtaggctgaggcaggagaatcgctcgaacctgggaggtggaggttttactgagcagagatcaccactgcattccagtctgggctggtgacagagtgagaccctgtctccaaaaaaaaaaaaaaaaaaaaagtaccagtcaggtgtacatgttctcttaaaacagtttttagatattacataaattcagaggttgggggaatggagatttgagtttcttcttagaatttatcagtaatttgtttttcctctcttcctacaatagcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagttttttttttctcttcttcttcttcttttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagatttcttagtgagtccttcatttttatgctgttctttcaaactttgtcctacttattgatattctaataagagtagatcactaaccctattaataatgtctaagtatttcaccccacttgaagattaagaaaaagtcttgcattaaattatgcaattcaaaataaccc

SEQ ID NO: 378021 - DNA, 3196 bp, Homo sapiens
ggcctcatcgctttatacttcttactaagtcatttttcagtttcctatgtatggttaagggaaaatgtaaataaatgcatcttttaaatttttaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggataaagatgacctctccccaactgctgaggtttgggatgtagaccagggactaataagtaaactgaaggaacagtacaagaaggaacgaaaggggaagaaaggggtgaagagggccaacaggacaaaactctacgacatgatagctgatctgggagatgatgagctgccccacatcccttcaggaatcattaatcagtctaggtcagcctctactagaatgactgatcatgaaggtgcaagagcagaggaagctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagttttttttttctcttcttcttcttctttttttttttttttttttggggccccgggggggccgccccaggggttgcagcaatggggcgcgcccttgtgtggggagagaaggtagacgccccaaaagagtatgcgcctttttacaactcctcttaaggagagctctccgtgtaaaccgggtgagatgcgcaaaaggatccccttttaaacactgttttgcgctttcaaaaaacacacacaaagaggaacaagaagaaactattcccgcttacaaaatatttttgcccttttgttgccccccaaagtggtcgtgcgttcaaccttccaaggcttacaaaagcctcttaatattatttgcgcccggtcaccacggtgcctaacagtgtgctgaatgtttctgtgggttttatacaccccttaaaagagagagcttcagtgcccggtgccgtgtacccatttcttccttttgtggccaaaaaagccaagaggctccaaaaggggcaaaactttccacaccaatagtgttcttcaaccacggccttctggtttcacgacagggggcgtccccagacttgaaaacaactgggctcacaggattcgccctgctcacgtatcagcagcgcgcgagggagaagcggggggtcataagagagcgttcttcgcaaggaccccctgtgctgtgtgca

SEQ ID NO: 378022 - DNA, 317 bp, Homo sapiens
catttttcagtttcctatgtatggttaagggaaaatgtaaataaatgcatcttttaaatttttaggcccggattgcatttctacaaggcgaaagaaaaggtcaagagaacctgaagaaggacttagtaagaagaataaagatgttagagtatgcattaaaacaagaaaggtatgtgtgcctcattttgttacatgaataaagtagaacaatagtatactcatgtataccattgtactctgtatttggcagctttttttgaaaggtacaaatccttgcccgaatacatgatgctgtcttgatttgattcatacttggg

SEQ ID NO: 378023 - DNA, 408 bp, Homo sapiens
ataaagatgacctctccccaactgctgaggtttgggatgtagaccagggactaataagtaaactgaaggaacagtacaagaaggaacgaaaggggaagaaaggggtgaagagtaagtgcagattctgactattataatttttgtataccaataattgagaaaaaagttcttcaattctgtttctttgtgtaacttaattttttgtttcataaagggggcaactaactttaaactttgtctgttgtataattgaaatttgtttgtatataatttaggatgtgttattgatcaagtagaaaatcatttaaaatatatgagaagggtaaaggaaagattttgaggattgtttttaagctttaaaaactttaccaaattgtttggaatattggcattggaataaaaaataaa

SEQ ID NO: 378024 - DNA, 3985 bp, Homo sapiens
ggcctcatcgctttatacttcttactaagtcatttttcagtttcctatgtatggttaagggaaaatgtaaataaatgcatcttttaaatttttaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggataaagatgacctctccccaactgctgaggtttgggatgtagaccagggactaataagtaaactgaaggaacagtacaagaaggaacgaaaggggaagaaaggggtgaagagggccaacaggacaaaactctacgacatgatagctgatctgggagatgatgagctgccccacatcccttcaggaatcattaatcagtctaggtcagcctctactagaatgactgatcatgaaggtgcaagagcagaggaagctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagttttttttttctcttcttcttcttcttttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagatttcttagtgagtccttcatttttatgctgttctttcaaactttgtcctacttattgatattctaataagagtagatcactaaccctattaataatgtctaagtatttcaccccacttgaagattaagaaaaagtcttgcattaaattatgcaattcaaaataaccc

SEQ ID NO: 378025 - DNA, 3961 bp, Homo sapiens
ggcctcatcgctttatacttcttactaagtcatttttcagtttcctatgtatggttaagggaaaatgtaaataaatgcatcttttaaatttttaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggataaagatgacctctccccaactgctgaggtttgggatgtagaccagggactaataagtaaactgaaggaacagtacaagaaggaacgaaaggggaagaaaggggtgaagagggccaacaggacaaaactctacgacatgatagctgatctgggagatgatgagctgccccacatcccttcaggaatcattaatcagtctaggtcagcctctactagaatgactgatcatgaaggtgcaagagcagaggaagctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagttttttttttctcttcttcttcttcttttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagatttcttagtgagtccttcatttttatgctgttctttcaaactttgtcctacttattgatattctaataagagtagatcactaaccctattaataatgtctaagtatttcaccccacttgaagattaagaaaaagtcttgcattaaattatgcaattcaaaataaccc

SEQ ID NO: 378026 - DNA, 468 bp, Homo sapiens
atttaaaagaaaggcatattggctgggcgcagtggctcacaggtaacccagcacttcgggaggccaaggccctcgtgccgaattcggcacgagggaaaaaatgtcgaatttgcctctagcctttcctgacaaccttagaaagcactgaggaaaaatttgatagattcatttgtatacattcagatttgaagacttctgctccgatttcaacatcaccatataaaacaaataatgtttctgcttcttaaacaaagctgttggagaatgtgcaccaccaaaataagggaataagtaaaggaggaagaagaccctgagttcaggaataaggtaccacaactagagacagtcaaagagaattcctaggataagagggtgaattaggaccagacagccacccctccagagggagggcagaatggaggactcaagaggatgtctcccagaaaataaaaatgcagctgaggatta

SEQ ID NO: 378027 - DNA, 5638 bp, Homo sapiens
atttaaaagaaaggcatattggctgggcgcagtggctcacaggtaacccagcacttcgggaggccaaggccctcgtgccgaattcggcacgagggaaaaaatgtcgaatttgcctctagcctttcctgacaaccttagaaagcactgaggaaaaatttgatagattcatttgtatacattcagatttgaagacttctgctccgatttcaacatcaccatataaaacaaataatgtttctgcttcttaaacaaagctgttggagaatgtgcaccaccaaaataagggaataagtaaaggaggaagaagaccctgagttcaggaataagaatggattggtttcattgcaaccagtgcttccgaaaagatggggcccatttctttgtcaccagctgtggccatattttctgtaaaaagtgtgtgactctggaaaaatgtgctgtttgtggaactgcctgcaagcatctggctctttctgataatctgaagcctcaggagaagatgtttttcaaaagtcctgtggagacagctttgcagtattttagtcacatctctcaggtgtggagtttccagaagaaacaaacagatctcctcatcgccttttataagcatagaattacaaagttagaaacagccatgcaggaggcacagcaagcactggtgagccaggacaaagaattgtcagtcttaaggaaggagaatggagaactgaagaaatttctagccattctaaaggaatctccaagtcggtaccaaggaagcaggtcaatcacacctcgaccagtgggcattacttccccatcacagtcagttaccccacgacccagtttccagcatagcagtcaagtggtcagtcggtcctcctcagcggaatctattccttatagagaggctggctttggtagcttgggacaaggaggcagaggtctgcagggaaggagaactcccagagactcttataatgaaaccccttcaccggcttcaactcatagcctatcttatagaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatgtatccctgcattgtttcctagtttcactctgtaccttatgctccccccatctttaccctattcacccttatcacctcccaggacagtggtcaggtcttacaaaaggctagtgcttcaggaagatgtttatatctcttccagaagacattggtagctcccctcatttcctacaatttggaacaaaggtcaaaaaaataattcttggcatcatgcttggttgggagttgggaatggggattgtgatggatcatatactcatcactgtttcatttctggatttcatttttagctttggatatactgtcccattgccaatgttaacgagcaatatctctgttcttttccttattatacttttttatttgtctattatttcctctatgcttagttactattaaatgttaattttcctttctattgaaaacaactgttggagacactgattttcagcttagtatatagatagtaaaataaagacgatgcccttttattgctacaattctatcacttttacaagctctagaatggtggaatgggcgaacaacactatcactgagatcaaacatgtattctactttgggttttaaaaggcagaaatgacgaattaaataggttagccactcacaagctggccttaagcaaaaatactggaaaaacagaaaatagcaggcatctgccagaaataaattaggtcttgggaatgatcttgtatctgaactaggatccccataccctttctggtactctgaatttattttaaaggcatttctagataccttctcttttaggcaagggcctgtcctgtagcaaatggagttacctccaagactgttgtatctctgttactcctgaagcctcagaaattttagtcattatcatttgatggctgagaaacaacctggctggcgatagatgctgaactacttcctttttacagtttttgttcttttaatttacctcaataagtcctgcccctccaaacaataagttaaaagtatgctgagttagaatgttaatggatttggttccattaatccctaaaccataggagtggcaaagtggttgagagagaaacaattttatttttggcctttttattattattctagcattttagggcttccactcttttatttttagatggttaactcattgatgatacctatttgccatatagctgatcccaactgatgaaaaccattctaaaacatcaataattaattcacttaaagacgatggtccctctgtccctaagacagatcctatcaagagagggaaaagtctcttttctggaaacaaattgacagcaaaaagatgaaaaattagtctctgtcaagctggacaggaggtagttaacaggtttgtaaaaccaaacctgaaacctaccttcactgcccttcaacaaggagaaactattccctctctttcacccctttgtaacacaattctactgtttaaaaggacatcttccctaattaccacctccaataaatatccattctaaattattctccacccaattattaaagttttttacaagctcggtgggggaagattttccctgagacaaacaatgaacagagtgaggattttggaaagatagaaaaagctacaaggcaaagtggtcacagcataagaactgaaaatagccgggcacggtggctcatgcctataatcccagcactttgggaggccaaggtgggcggatcatgaggtcaggagatcaagaccatcctggctaacatgatgaaacccgtctctactaaaaatataaaaaagtagccgggtgtggtggcaggtgcctgtagtcccagctactcgggaggctgaggcaggagaatggcatgaacctgggaggcggagcttgcagtgagctgagattgcgccattgcactacagcctgggcgacagagcaagactccacctcaaaaaaaaaaaaaagaactgaaaaattctgccacctgtgatttagtcatgaagcgggtgaaacatagtcaagttggtatgaggaaaaggaaatattaatatttgtgatgagactgggacttattgagaatcttggttgtctaggaaatgatcagttactaagaaaaaagtaagagagtcagttgcattacgcacagacttgtgctcagaaaaggggtacaaggcagccttatattccaggtaagatggtgggattggggatgcactggaatcatcaatcaaatcagaatcctttactcctcctttccaatcctcctggagaggtggtgccaacatctggcctctgtatagtacaccaagggaaaaaaacagcagacacgaggagagcaagagcagcttcccagcccatggtttccccagatccttagcactccctaccctaaggttagagggttggatttctgctgatccaatcccagccttacttagtgccctatggtcattctccctggtccaccctcactatatccccctgccacccaccctgaagaacacaaagctttttagttctctgccacaaggtaattttaaaaatgtggtttctttgtttaaacagttactaagttggttcatctttcagtaacagacctcccctcccccagctccccactcagtcttgtatgatcacatcatcatcatcatcatcatcttcctcctcctcctcctcctcttcctcatcatcttctggcagttcttcctcctcctcttcctcttcttcatctagacaaactaccacctcagctggctgaggtaatcgagagtcaaaccaatccagcacctgctgggtgctaagccttgatgcctgactcaattgagggatatcagtttcccgtagctgttggtgggctgcccagtacctctccaagggttgtatatccggtgggggtggagggatcggcagaggtggtgtctcagccctttcgttcaaggagcgggttgatggtggtggtgtaggaattgctgggtcttggaaactaggggcaccaggtactgcgttgtcccgaaaccactttagttgcccatgcttcaaggcatagcgtgtgtcaccaaaccactgaatgatctcaggccgaggtaaaccagtgatctgttctaacttttggtaatcctcacgccgtgcccactggcactgtaaaaaaaaggatttaaggatagccagctgctctttggttttgcgcttggtctttcgctggcgttgcatatctggggaaaggtactctgtggggccaactctacctggtactgagttatgccgtagcccttggggccaggctggttccagatgtgggggtaatgcctgttcactgggtgacactgactgtgggacacagcctagtggctggaggggtttagaggcggcagtagctccattagccagtacctggaaagaagaagaggtagaggaagaagagggagtaacactagatgctgactcctccttacaactactggcaattaatgcaattggtgggggtttatcccgagcttgtggctgggggacggttgtggagtggttccaggaagcagtacctatgccatgtgactggttgggacccctgcctgcctgctcctttgagaggccactgctttgaagatgttgccaaaaatctgattggtaggggaatgctccactgccaggtgtcatcagggactcctttaatttctggtgactctgtggcagtggtggcatctgagagggctcctcaggctctaccttcaatcctttcgtctgggtaggcttgctaagagttggaggacctattccaataccaacttgctctggagctggcactggaggaggaggcacctcctctgggggccgtcccgcatgatgagtaaaagagagaagggatttgaaatggagttggtcccgacggtagactactcgggctcgagtctcttctatttcttcagatgaccagctaataccacagcggaggcgctgggccataaaccaagtcttgactttctccatctgcaacccataacgtaggcagagaagggcaatgtctgctaggctgggatagggaaagtagctgaaggttttgagcaggtgttcattgctgtctagctcactggtctgggctgcttgcgtccacacaagctgtagctcctcagagattggagggaggcagatgagccccgctggtgaactactgagaccgctggcctctttattaggaggcatggtgccttctgatttgtgcccttcagagatagcgcagtccagcccgggcggcggctcccagcctcgcaccatgggccggggggaagtgggggagagggcagggggcctccgagtgggagtggggttgctgcccggtgcggccgccc

SEQ ID NO: 378028 - DNA, 5458 bp, Homo sapiens
atttaaaagaaaggcatattggctgggcgcagtggctcacaggtaacccagcacttcgggaggccaaggccctcgtgccgaattcggcacgagggaaaaaatgtcgaatttgcctctagcctttcctgacaaccttagaaagcactgaggaaaaatttgatagattcatttgtatacattcagatttgaagacttctgctccgatttcaacatcaccatataaaacaaataatgtttctgcttcttaaacaaagctgttggagaatgtgcaccaccaaaataagggaataagtaaaggaggaagaagaccctgagttcaggaataagaatggattggtttcattgcaaccagtgcttccgaaaagatggggcccatttctttgtcaccagctgtggccatattttctgtaaaaagtgtgtgactctggaaaaatgtgctgtttgtggaactgcctgcaagcatctggctctttctgataatctgaagcctcaggagaagatgtttttcaaaagtcctgtggagacagctttgcagtattttagtcacatctctcaggtgtggagtttccagaagaaacaaacagatctcctcatcgccttttataagcatagaattacaaagttagaaacagccatgcaggaggcacagcaagcactggtgagccaggacaatcggtcctcctcagcggaatctattccttatagagaggctggctttggtagcttgggacaaggaggcagaggtctgcagggaaggagaactcccagagactcttataatgaaaccccttcaccggcttcaactcatagcctatcttatagaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatgtatccctgcattgtttcctagtttcactctgtaccttatgctccccccatctttaccctattcacccttatcacctcccaggacagtggtcaggtcttacaaaaggctagtgcttcaggaagatgtttatatctcttccagaagacattggtagctcccctcatttcctacaatttggaacaaaggtcaaaaaaataattcttggcatcatgcttggttgggagttgggaatggggattgtgatggatcatatactcatcactgtttcatttctggatttcatttttagctttggatatactgtcccattgccaatgttaacgagcaatatctctgttcttttccttattatacttttttatttgtctattatttcctctatgcttagttactattaaatgttaattttcctttctattgaaaacaactgttggagacactgattttcagcttagtatatagatagtaaaataaagacgatgcccttttattgctacaattctatcacttttacaagctctagaatggtggaatgggcgaacaacactatcactgagatcaaacatgtattctactttgggttttaaaaggcagaaatgacgaattaaataggttagccactcacaagctggccttaagcaaaaatactggaaaaacagaaaatagcaggcatctgccagaaataaattaggtcttgggaatgatcttgtatctgaactaggatccccataccctttctggtactctgaatttattttaaaggcatttctagataccttctcttttaggcaagggcctgtcctgtagcaaatggagttacctccaagactgttgtatctctgttactcctgaagcctcagaaattttagtcattatcatttgatggctgagaaacaacctggctggcgatagatgctgaactacttcctttttacagtttttgttcttttaatttacctcaataagtcctgcccctccaaacaataagttaaaagtatgctgagttagaatgttaatggatttggttccattaatccctaaaccataggagtggcaaagtggttgagagagaaacaattttatttttggcctttttattattattctagcattttagggcttccactcttttatttttagatggttaactcattgatgatacctatttgccatatagctgatcccaactgatgaaaaccattctaaaacatcaataattaattcacttaaagacgatggtccctctgtccctaagacagatcctatcaagagagggaaaagtctcttttctggaaacaaattgacagcaaaaagatgaaaaattagtctctgtcaagctggacaggaggtagttaacaggtttgtaaaaccaaacctgaaacctaccttcactgcccttcaacaaggagaaactattccctctctttcacccctttgtaacacaattctactgtttaaaaggacatcttccctaattaccacctccaataaatatccattctaaattattctccacccaattattaaagttttttacaagctcggtgggggaagattttccctgagacaaacaatgaacagagtgaggattttggaaagatagaaaaagctacaaggcaaagtggtcacagcataagaactgaaaatagccgggcacggtggctcatgcctataatcccagcactttgggaggccaaggtgggcggatcatgaggtcaggagatcaagaccatcctggctaacatgatgaaacccgtctctactaaaaatataaaaaagtagccgggtgtggtggcaggtgcctgtagtcccagctactcgggaggctgaggcaggagaatggcatgaacctgggaggcggagcttgcagtgagctgagattgcgccattgcactacagcctgggcgacagagcaagactccacctcaaaaaaaaaaaaaagaactgaaaaattctgccacctgtgatttagtcatgaagcgggtgaaacatagtcaagttggtatgaggaaaaggaaatattaatatttgtgatgagactgggacttattgagaatcttggttgtctaggaaatgatcagttactaagaaaaaagtaagagagtcagttgcattacgcacagacttgtgctcagaaaaggggtacaaggcagccttatattccaggtaagatggtgggattggggatgcactggaatcatcaatcaaatcagaatcctttactcctcctttccaatcctcctggagaggtggtgccaacatctggcctctgtatagtacaccaagggaaaaaaacagcagacacgaggagagcaagagcagcttcccagcccatggtttccccagatccttagcactccctaccctaaggttagagggttggatttctgctgatccaatcccagccttacttagtgccctatggtcattctccctggtccaccctcactatatccccctgccacccaccctgaagaacacaaagctttttagttctctgccacaaggtaattttaaaaatgtggtttctttgtttaaacagttactaagttggttcatctttcagtaacagacctcccctcccccagctccccactcagtcttgtatgatcacatcatcatcatcatcatcatcttcctcctcctcctcctcctcttcctcatcatcttctggcagttcttcctcctcctcttcctcttcttcatctagacaaactaccacctcagctggctgaggtaatcgagagtcaaaccaatccagcacctgctgggtgctaagccttgatgcctgactcaattgagggatatcagtttcccgtagctgttggtgggctgcccagtacctctccaagggttgtatatccggtgggggtggagggatcggcagaggtggtgtctcagccctttcgttcaaggagcgggttgatggtggtggtgtaggaattgctgggtcttggaaactaggggcaccaggtactgcgttgtcccgaaaccactttagttgcccatgcttcaaggcatagcgtgtgtcaccaaaccactgaatgatctcaggccgaggtaaaccagtgatctgttctaacttttggtaatcctcacgccgtgcccactggcactgtaaaaaaaaggatttaaggatagccagctgctctttggttttgcgcttggtctttcgctggcgttgcatatctggggaaaggtactctgtggggccaactctacctggtactgagttatgccgtagcccttggggccaggctggttccagatgtgggggtaatgcctgttcactgggtgacactgactgtgggacacagcctagtggctggaggggtttagaggcggcagtagctccattagccagtacctggaaagaagaagaggtagaggaagaagagggagtaacactagatgctgactcctccttacaactactggcaattaatgcaattggtgggggtttatcccgagcttgtggctgggggacggttgtggagtggttccaggaagcagtacctatgccatgtgactggttgggacccctgcctgcctgctcctttgagaggccactgctttgaagatgttgccaaaaatctgattggtaggggaatgctccactgccaggtgtcatcagggactcctttaatttctggtgactctgtggcagtggtggcatctgagagggctcctcaggctctaccttcaatcctttcgtctgggtaggcttgctaagagttggaggacctattccaataccaacttgctctggagctggcactggaggaggaggcacctcctctgggggccgtcccgcatgatgagtaaaagagagaagggatttgaaatggagttggtcccgacggtagactactcgggctcgagtctcttctatttcttcagatgaccagctaataccacagcggaggcgctgggccataaaccaagtcttgactttctccatctgcaacccataacgtaggcagagaagggcaatgtctgctaggctgggatagggaaagtagctgaaggttttgagcaggtgttcattgctgtctagctcactggtctgggctgcttgcgtccacacaagctgtagctcctcagagattggagggaggcagatgagccccgctggtgaactactgagaccgctggcctctttattaggaggcatggtgccttctgatttgtgcccttcagagatagcgcagtccagcccgggcggcggctcccagcctcgcaccatgggccggggggaagtgggggagagggcagggggcctccgagtgggagtggggttgctgcccggtgcggccgccc

SEQ ID NO: 378029 - DNA, 4403 bp, Homo sapiens
aattgtgggagctaagaacataaattaccccacgacccagtttccagcatagcagtcaagtggtcagggaggcagaggtctgcagggaaggagaactcccagagactcttataatgaaaccccttcaccggcttcaactcatagcctatcttatagaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatttactattaaatgttaattttcctttctattgaaaacaactgttggagacactgattttcagcttagtatatagatagtaaaataaagacgatgcccttttattgctacaattctatcacttttacaagctctagaatggtggaatgggcgaacaacactatcactgagatcaaacatgtattctactttgggttttaaaaggcagaaatgacgaattaaataggttagccactcacaagctggccttaagcaaaaatactggaaaaacagaaaatagcaggcatctgccagaaataaattaggtcttgggaatgatcttgtatctgaactaggatccccataccctttctggtactctgaatttattttaaaggcatttctagataccttctcttttaggcaagggcctgtcctgtagcaaatggagttacctccaagactgttgtatctctgttactcctgaagcctcagaaattttagtcattatcatttgatggctgagaaacaacctggctggcgatagatgctgaactacttcctttttacagtttttgttcttttaatttacctcaataagtcctgcccctccaaacaataagttaaaagtatgctgagttagaatgttaatggatttggttccattaatccctaaaccataggagtggcaaagtggttgagagagaaacaattttatttttggcctttttattattattctagcattttagggcttccactcttttatttttagatggttaactcattgatgatacctatttgccatatagctgatcccaactgatgaaaaccattctaaaacatcaataattaattcacttaaagacgatggtccctctgtccctaagacagatcctatcaagagagggaaaagtctcttttctggaaacaaattgacagcaaaaagatgaaaaattagtctctgtcaagctggacaggaggtagttaacaggtttgtaaaaccaaacctgaaacctaccttcactgcccttcaacaaggagaaactattccctctctttcacccctttgtaacacaattctactgtttaaaaggacatcttccctaattaccacctccaataaatatccattctaaattattctccacccaattattaaagttttttacaagctcggtgggggaagattttccctgagacaaacaatgaacagagtgaggattttggaaagatagaaaaagctacaaggcaaagtggtcacagcataagaactgaaaatagccgggcacggtggctcatgcctataatcccagcactttgggaggccaaggtgggcggatcatgaggtcaggagatcaagaccatcctggctaacatgatgaaacccgtctctactaaaaatataaaaaagtagccgggtgtggtggcaggtgcctgtagtcccagctactcgggaggctgaggcaggagaatggcatgaacctgggaggcggagcttgcagtgagctgagattgcgccattgcactacagcctgggcgacagagcaagactccacctcaaaaaaaaaaaaaagaactgaaaaattctgccacctgtgatttagtcatgaagcgggtgaaacatagtcaagttggtatgaggaaaaggaaatattaatatttgtgatgagactgggacttattgagaatcttggttgtctaggaaatgatcagttactaagaaaaaagtaagagagtcagttgcattacgcacagacttgtgctcagaaaaggggtacaaggcagccttatattccaggtaagatggtgggattggggatgcactggaatcatcaatcaaatcagaatcctttactcctcctttccaatcctcctggagaggtggtgccaacatctggcctctgtatagtacaccaagggaaaaaaacagcagacacgaggagagcaagagcagcttcccagcccatggtttccccagatccttagcactccctaccctaaggttagagggttggatttctgctgatccaatcccagccttacttagtgccctatggtcattctccctggtccaccctcactatatccccctgccacccaccctgaagaacacaaagctttttagttctctgccacaaggtaattttaaaaatgtggtttctttgtttaaacagttactaagttggttcatctttcagtaacagacctcccctcccccagctccccactcagtcttgtatgatcacatcatcatcatcatcatcatcttcctcctcctcctcctcctcttcctcatcatcttctggcagttcttcctcctcctcttcctcttcttcatctagacaaactaccacctcagctggctgaggtaatcgagagtcaaaccaatccagcacctgctgggtgctaagccttgatgcctgactcaattgagggatatcagtttcccgtagctgttggtgggctgcccagtacctctccaagggttgtatatccggtgggggtggagggatcggcagaggtggtgtctcagccctttcgttcaaggagcgggttgatggtggtggtgtaggaattgctgggtcttggaaactaggggcaccaggtactgcgttgtcccgaaaccactttagttgcccatgcttcaaggcatagcgtgtgtcaccaaaccactgaatgatctcaggccgaggtaaaccagtgatctgttctaacttttggtaatcctcacgccgtgcccactggcactgtaaaaaaaaggatttaaggatagccagctgctctttggttttgcgcttggtctttcgctggcgttgcatatctggggaaaggtactctgtggggccaactctacctggtactgagttatgccgtagcccttggggccaggctggttccagatgtgggggtaatgcctgttcactgggtgacactgactgtgggacacagcctagtggctggaggggtttagaggcggcagtagctccattagccagtacctggaaagaagaagaggtagaggaagaagagggagtaacactagatgctgactcctccttacaactactggcaattaatgcaattggtgggggtttatcccgagcttgtggctgggggacggttgtggagtggttccaggaagcagtacctatgccatgtgactggttgggacccctgcctgcctgctcctttgagaggccactgctttgaagatgttgccaaaaatctgattggtaggggaatgctccactgccaggtgtcatcagggactcctttaatttctggtgactctgtggcagtggtggcatctgagagggctcctcaggctctaccttcaatcctttcgtctgggtaggcttgctaagagttggaggacctattccaataccaacttgctctggagctggcactggaggaggaggcacctcctctgggggccgtcccgcatgatgagtaaaagagagaagggatttgaaatggagttggtcccgacggtagactactcgggctcgagtctcttctatttcttcagatgaccagctaataccacagcggaggcgctgggccataaaccaagtcttgactttctccatctgcaacccataacgtaggcagagaagggcaatgtctgctaggctgggatagggaaagtagctgaaggttttgagcaggtgttcattgctgtctagctcactggtctgggctgcttgcgtccacacaagctgtagctcctcagagattggagggaggcagatgagccccgctggtgaactactgagaccgctggcctctttattaggaggcatggtgccttctgatttgtgcccttcagagatagcgcagtccagcccgggcggcggctcccagcctcgcaccatgggccggggggaagtgggggagagggcagggggcctccgagtgggagtggggttgctgcccggtgcggccgccc

SEQ ID NO: 378030 - DNA, 2614 bp, Homo sapiens
gtcaatcatttcaaagaattcgttttgttgagagtctgtattacttcttctattatctgtttcatttacttctggtttagtctatttccttccttctcattattttggatttagttctttttctagtttcctaaggtggaagtttcgattattgatttgagatcttttttactattgatgtttccagtcataaatttcactgtagcactgcttttactgcatcctataacatttggcatgctgtgttttgtttacattcattccaaaggttgtttgttcatttgtgtttttttttgagatggggaaaaggaaatattaatatttgtgatgagactgggacttattgagaatcttggttgtctaggaaatgatcagttactaagaaaaaagtaagagagtcagttgcattacgcacagacttgtgctcagaaaaggggtacaaggcagccttatattccaggtaagatggtgggattggggatgcactggaatcatcaatcaaatcagaatcctttactcctcctttccaatcctcctggagaggtggtgccaacatctggcctctgtatagtacaccaagggaaaaaaacagcagacacgaggagagcaagagcagcttcccagcccatggtttccccagatccttagcactccctaccctaaggttagagggttggatttctgctgatccaatcccagccttacttagtgccctatggtcattctccctggtccaccctcactatatccccctgccacccaccctgaagaacacaaagctttttagttctctgccacaaggtaattttaaaaatgtggtttctttgtttaaacagttactaagttggttcatctttcagtaacagacctcccctcccccagctccccactcagtcttgtatgatcacatcatcatcatcatcatcatcttcctcctcctcctcctcctcttcctcatcatcttctggcagttcttcctcctcctcttcctcttcttcatctagacaaactaccacctcagctggctgaggtaatcgagagtcaaaccaatccagcacctgctgggtgctaagccttgatgcctgactcaattgagggatatcagtttcccgtagctgttggtgggctgcccagtacctctccaagggttgtatatccggtgggggtggagggatcggcagaggtggtgtctcagccctttcgttcaaggagcgggttgatggtggtggtgtaggaattgctgggtcttggaaactaggggcaccaggtactgcgttgtcccgaaaccactttagttgcccatgcttcaaggcatagcgtgtgtcaccaaaccactgaatgatctcaggccgaggtaaaccagtgatctgttctaacttttggtaatcctcacgccgtgcccactggcactgtaaaaaaaaggatttaaggatagccagctgctctttggttttgcgcttggtctttcgctggcgttgcatatctggggaaaggtactctgtggggccaactctacctggtactgagttatgccgtagcccttggggccaggctggttccagatgtgggggtaatgcctgttcactgggtgacactgactgtgggacacagcctagtggctggaggggtttagaggcggcagtagctccattagccagtacctggaaagaagaagaggtagaggaagaagagggagtaacactagatgctgactcctccttacaactactggcaattaatgcaattggtgggggtttatcccgagcttgtggctgggggacggttgtggagtggttccaggaagcagtacctatgccatgtgactggttgggacccctgcctgcctgctcctttgagaggccactgctttgaagatgttgccaaaaatctgattggtaggggaatgctccactgccaggtgtcatcagggactcctttaatttctggtgactctgtggcagtggtggcatctgagagggctcctcaggctctaccttcaatcctttcgtctgggtaggcttgctaagagttggaggacctattccaataccaacttgctctggagctggcactggaggaggaggcacctcctctgggggccgtcccgcatgatgagtaaaagagagaagggatttgaaatggagttggtcccgacggtagactactcgggctcgagtctcttctatttcttcagatgaccagctaataccacagcggaggcgctgggccataaaccaagtcttgactttctccatctgcaacccataacgtaggcagagaagggcaatgtctgctaggctgggatagggaaagtagctgaaggttttgagcaggtgttcattgctgtctagctcactggtctgggctgcttgcgtccacacaagctgtagctcctcagagattggagggaggcagatgagccccgctggtgaactactgagaccgctggcctctttattaggaggcatggtgccttctgatttgtgcccttcagagatagcgcagtccagcccgggcggcggctcccagcctcgcaccatgggccggggggaagtgggggagagggcagggggcctccgagtgggagtggggttgctgcccggtgcggccgccc

SEQ ID NO: 378031 - DNA, 479 bp, Homo sapiens
atttaaaagaaaggcatattggctgggcgcagtggctcacaggtaacccagcacttcgggaggccaaggccctcgtgccgaattcggcacgagggaaaaaatgtcgaatttgcctctagcctttcctgacaaccttagaaagcactgaggaaaaatttgatagattcatttgtatacattcagatttgaagacttctgctccgatttcaacatcaccatataaaacaaataatgtttctgcttcttaaacggtttatgcagtcctgagaatttggatgcagctgaccctgctttgttatgatggttaattaattcagctcttctggagataatgatgaatccttgctctgacaccagagacaaaaattccaacagattactcctctgtctgctgcacttggtgggattccatggagccagcccagcactagtgggaaagaaataaagaggcactgcctgtggcaggccagatctccgca

SEQ ID NO: 378032 - DNA, 5555 bp, Homo sapiens
atttaaaagaaaggcatattggctgggcgcagtggctcacaggtaacccagcacttcgggaggccaaggccctcgtgccgaattcggcacgagggaaaaaatgtcgaatttgcctctagcctttcctgacaaccttagaaagcactgaggaaaaatttgatagattcatttgtatacattcagatttgaagacttctgctccgatttcaacatcaccatataaaacaaataatgtttctgcttcttaaacaaagctgttggagaatgtgcaccaccaaaataagggaataagtaaaggaggaagaagaccctgagttcaggaataagaatggattggtttcattgcaaccagtgcttccgaaaagatggggcccatttctttgtcaccagctgtggccatattttctgtaaaaagtgtgtgactctggaaaaatgtgctgtttgtggaactgcctgcaagcatctggctctttctgataatctgaagcctcaggagaagatgtttttcaaaagtcctgtggagacagctttgcagtattttagtcacatctctcaggtgtggagtttccagaagaaacaaacagatctcctcatcgccttttataagcatagaattacaaagttagaaacagccatgcaggaggcacagcaagcactggtgagccaggacaaagaattgtcagtcttaaggaaggagaatggagaactgaagaaatttctagccattctaaaggaatctccaagtcggtaccaaggaagcaggtcaatcacacctcgaccagtgggcattacttccccatcacagtcagtcggtcctcctcagcggaatctattccttatagagaggctggctttggtagcttgggacaaggaggcagaggtctgcagggaaggagaactcccagagactcttataatgaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatgtatccctgcattgtttcctagtttcactctgtaccttatgctccccccatctttaccctattcacccttatcacctcccaggacagtggtcaggtcttacaaaaggctagtgcttcaggaagatgtttatatctcttccagaagacattggtagctcccctcatttcctacaatttggaacaaaggtcaaaaaaataattcttggcatcatgcttggttgggagttgggaatggggattgtgatggatcatatactcatcactgtttcatttctggatttcatttttagctttggatatactgtcccattgccaatgttaacgagcaatatctctgttcttttccttattatacttttttatttgtctattatttcctctatgcttagttactattaaatgttaattttcctttctattgaaaacaactgttggagacactgattttcagcttagtatatagatagtaaaataaagacgatgcccttttattgctacaattctatcacttttacaagctctagaatggtggaatgggcgaacaacactatcactgagatcaaacatgtattctactttgggttttaaaaggcagaaatgacgaattaaataggttagccactcacaagctggccttaagcaaaaatactggaaaaacagaaaatagcaggcatctgccagaaataaattaggtcttgggaatgatcttgtatctgaactaggatccccataccctttctggtactctgaatttattttaaaggcatttctagataccttctcttttaggcaagggcctgtcctgtagcaaatggagttacctccaagactgttgtatctctgttactcctgaagcctcagaaattttagtcattatcatttgatggctgagaaacaacctggctggcgatagatgctgaactacttcctttttacagtttttgttcttttaatttacctcaataagtcctgcccctccaaacaataagttaaaagtatgctgagttagaatgttaatggatttggttccattaatccctaaaccataggagtggcaaagtggttgagagagaaacaattttatttttggcctttttattattattctagcattttagggcttccactcttttatttttagatggttaactcattgatgatacctatttgccatatagctgatcccaactgatgaaaaccattctaaaacatcaataattaattcacttaaagacgatggtccctctgtccctaagacagatcctatcaagagagggaaaagtctcttttctggaaacaaattgacagcaaaaagatgaaaaattagtctctgtcaagctggacaggaggtagttaacaggtttgtaaaaccaaacctgaaacctaccttcactgcccttcaacaaggagaaactattccctctctttcacccctttgtaacacaattctactgtttaaaaggacatcttccctaattaccacctccaataaatatccattctaaattattctccacccaattattaaagttttttacaagctcggtgggggaagattttccctgagacaaacaatgaacagagtgaggattttggaaagatagaaaaagctacaaggcaaagtggtcacagcataagaactgaaaatagccgggcacggtggctcatgcctataatcccagcactttgggaggccaaggtgggcggatcatgaggtcaggagatcaagaccatcctggctaacatgatgaaacccgtctctactaaaaatataaaaaagtagccgggtgtggtggcaggtgcctgtagtcccagctactcgggaggctgaggcaggagaatggcatgaacctgggaggcggagcttgcagtgagctgagattgcgccattgcactacagcctgggcgacagagcaagactccacctcaaaaaaaaaaaaaagaactgaaaaattctgccacctgtgatttagtcatgaagcgggtgaaacatagtcaagttggtatgaggaaaaggaaatattaatatttgtgatgagactgggacttattgagaatcttggttgtctaggaaatgatcagttactaagaaaaaagtaagagagtcagttgcattacgcacagacttgtgctcagaaaaggggtacaaggcagccttatattccaggtaagatggtgggattggggatgcactggaatcatcaatcaaatcagaatcctttactcctcctttccaatcctcctggagaggtggtgccaacatctggcctctgtatagtacaccaagggaaaaaaacagcagacacgaggagagcaagagcagcttcccagcccatggtttccccagatccttagcactccctaccctaaggttagagggttggatttctgctgatccaatcccagccttacttagtgccctatggtcattctccctggtccaccctcactatatccccctgccacccaccctgaagaacacaaagctttttagttctctgccacaaggtaattttaaaaatgtggtttctttgtttaaacagttactaagttggttcatctttcagtaacagacctcccctcccccagctccccactcagtcttgtatgatcacatcatcatcatcatcatcatcttcctcctcctcctcctcctcttcctcatcatcttctggcagttcttcctcctcctcttcctcttcttcatctagacaaactaccacctcagctggctgaggtaatcgagagtcaaaccaatccagcacctgctgggtgctaagccttgatgcctgactcaattgagggatatcagtttcccgtagctgttggtgggctgcccagtacctctccaagggttgtatatccggtgggggtggagggatcggcagaggtggtgtctcagccctttcgttcaaggagcgggttgatggtggtggtgtaggaattgctgggtcttggaaactaggggcaccaggtactgcgttgtcccgaaaccactttagttgcccatgcttcaaggcatagcgtgtgtcaccaaaccactgaatgatctcaggccgaggtaaaccagtgatctgttctaacttttggtaatcctcacgccgtgcccactggcactgtaaaaaaaaggatttaaggatagccagctgctctttggttttgcgcttggtctttcgctggcgttgcatatctggggaaaggtactctgtggggccaactctacctggtactgagttatgccgtagcccttggggccaggctggttccagatgtgggggtaatgcctgttcactgggtgacactgactgtgggacacagcctagtggctggaggggtttagaggcggcagtagctccattagccagtacctggaaagaagaagaggtagaggaagaagagggagtaacactagatgctgactcctccttacaactactggcaattaatgcaattggtgggggtttatcccgagcttgtggctgggggacggttgtggagtggttccaggaagcagtacctatgccatgtgactggttgggacccctgcctgcctgctcctttgagaggccactgctttgaagatgttgccaaaaatctgattggtaggggaatgctccactgccaggtgtcatcagggactcctttaatttctggtgactctgtggcagtggtggcatctgagagggctcctcaggctctaccttcaatcctttcgtctgggtaggcttgctaagagttggaggacctattccaataccaacttgctctggagctggcactggaggaggaggcacctcctctgggggccgtcccgcatgatgagtaaaagagagaagggatttgaaatggagttggtcccgacggtagactactcgggctcgagtctcttctatttcttcagatgaccagctaataccacagcggaggcgctgggccataaaccaagtcttgactttctccatctgcaacccataacgtaggcagagaagggcaatgtctgctaggctgggatagggaaagtagctgaaggttttgagcaggtgttcattgctgtctagctcactggtctgggctgcttgcgtccacacaagctgtagctcctcagagattggagggaggcagatgagccccgctggtgaactactgagaccgctggcctctttattaggaggcatggtgccttctgatttgtgcccttcagagatagcgcagtccagcccgggcggcggctcccagcctcgcaccatgggccggggggaagtgggggagagggcagggggcctccgagtgggagtggggttgctgcccggtgcggccgccc

SEQ ID NO: 378033 - DNA, 440 bp, Homo sapiens
gtcacacctccactttcctccccctacccccgctcttcctgctaccttctccctgagctctctccagttgcctcttcatctcccgcctcactgtgtccagaggtgacctcctcaaaagtaggaccgggcatgagtttgcaggagaagggctccttgacccaccactcctagcagccactgtcactaacaggtgctcaaggtcaaggtctcttgccctgcactgtggaaacctcctgggcaggggtcaagctgatgggggcccatgaatcctggcctagctattaccaggtgttgtcacagataaataaaggctattttttatgctgggtattttttctaacgtttgtatgtgaatctagagacgctcctacatgggggtggaaagtcccgtcccttgtggacagcagcccaagcccagccggggccttgcctcctaggtc

SEQ ID NO: 378034 - DNA, 529 bp, Homo sapiens
tggacagccaaggatggacagcacagaggaggtggacagcacagaggaggtggacagcacaggaggccgcggggcctgaaaggacgcagcctggtaccttcccctctccaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgcactt

SEQ ID NO: 378035 - DNA, 1856 bp, Homo sapiens
cggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacactccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggacgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcctgtcgtgagcagaaaggcccggggaggatgacggcccaggccctggttctctgcccagcgaagcaggagtagctgccgggccccacgagcctccatccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgcactt

SEQ ID NO: 378036 - DNA, 2022 bp, Homo sapiens
cggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacactccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggacgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcctgtcgtgagcagaaaggcccggggaggatgacggcccaggccctggttctctgcccagcgaagcaggagtagctgccgggccccacgagcctccatccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgcactt

SEQ ID NO: 378037 - DNA, 336 bp, Homo sapiens
tctcgcccctgtaacttatacgccacccagctcagttttgtcacttttctagccaaagcaagaccagtaggaaagcaaacccttgactctggcaggatttgcaggcagcaggcagcacccctctgccagccgggctccggctgcagaagtgctgttggcttggatgctgtgtgcctgtcaagattccctccggttttctggctagaaagctcacccgtttccggttttaagagtcagttcagtggcagagccaccagggacaagtgaggctcttgggggtggtttgaccctgcttacctgggagcacacttttcccttccccgatgacctgggatg

SEQ ID NO: 378038 - DNA, 465 bp, Homo sapiens
gaaaccctatctctactaaaattacaaaattagctgggcgtggtggcacatgcctgtaatcccaactactgcggaggctgaggcaggagaatctcttgaacccaggaggcagatgttgcagtgagccgagaccacaccattgcactccagcctgggcaacaagaacaaaactccttttccaaaaaaaaatcatggcagttcctattctttccttccttttgaactaccgagatcagctagaacccttgaacttcaagtgcaagttaagaggcatctctgtaaaacacaaagataaacatacttgacaaggctgcatcggctctcactctttggttgctctttctcttctatacttagttccttttctcactcccttttgtataaactaatattccacgggaatcttcccaggatggttttgagaagtgtttgatgacttacgcagtgaaatcctgtgagacccca

SEQ ID NO: 378039 - DNA, 607 bp, Homo sapiens
cccaagtagctggggctatagtcacaggccaccacacctggctgatttttcaattttttgtagaaacggggtcttgtacgttgcctgggctggtcttgaactgttggtctcaagtgatccttccaccttggtctcccaaagcactgggattacagatgtcagccaccgggcctacctaagaaaaatatttaaatttaatatcagtatctgtggggaattggttccaggaccccctgaggataccaaaatccatggatgctcaagttccttatataacatggtatagtatttgcatataacctatacgcatcttcccacaaacttttaatcctctctagattatttatgatacctaatacgatgtaaatgctatgtaaatagttgttatatggtattgtttagggaacaatgccaaggaaaaaagtctacatgttcagtagagacacaacttttcattttctttcctgaatatttttgatacgcggttggttgaatccactatgcagaacccacagatctggaggacctactataatttaatttaattctaagcttataatatgactcgatggaggagctttttgcctagagcttggcttgtgagggg

SEQ ID NO: 378040 - DNA, 5497 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378041 - DNA, 4127 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatcctcggccgattcaccaccagcctcgcacctagcctacggtggctttctcctcccca

SEQ ID NO: 378042 - DNA, 3238 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttacta

SEQ ID NO: 378043 - DNA, 3461 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctcttatataaatacatccaattccatcccaaactgaacagaaagctgatgattaaaacacgtctcaactgagtgtaccaacgtacatatgtccacagctcagtagccactaaaaccacgatgcagagcagacaaagaagtaccttaaaacagagagaagcagaaatcagccaccaaaaacacttaagacagctaaaaagaactggactcaaaagcacaaaatcatttctacaattttgtggcttgttcatcaatacggtataagtgacctagtacaggttcttaacgtaattatggtggagtttggaaagtattttaaaaaggaaacttaatgacgttgcccttgccctcatcccatcttaccattaacacattatatggatccactccaaaggaatcttcgaatcgccacttcc

SEQ ID NO: 378044 - DNA, 5193 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378045 - DNA, 3248 bp, Homo sapiens
  misc_feature (1)..(2): n is a, c, g, or t
  misc_feature (9)..(10): n is a, c, g, or t
  misc_feature (35)..(35): n is a, c, g, or t
  misc_feature (37)..(37): n is a, c, g, or t
  misc_feature (47)..(48): n is a, c, g, or t
nnaaaaaannaaaaaaaaaaaaaaaaaaaatgaananaaaagagaanngaaaatgaaataaaaaaaaaaaatttttacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378046 - DNA, 3010 bp, Homo sapiens
gagcgaggaggtgtgtagccgtcttctattctccttccgtcctcctccctctgaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378047 - DNA, 5443 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378048 - DNA, 2694 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaagtatgtctgtatatttttttcgttctgcatacagctcagataccactgaaaacattggtagtgttataattctcattcaggaagggcttattttgtattagagagttattattgtccatcattcagtaaaaaattattgaacaccgattatgt

SEQ ID NO: 378049 - DNA, 2644 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaaggacaaataacagaaggtcagggttcatgcctttttctttttttcctgaaatgttaacacttatttattctctgtgtaggg

SEQ ID NO: 378050 - DNA, 1830 bp, Homo sapiens
tttttttttaaatagagacagggtcttgctatgttacccaggctggatctatgaaaaataaatcagcagccaggcgcagtggctcacacctgtaatcccagcactttgcaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378051 - DNA, 422 bp, Homo sapiens
gagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacaggtaagactattgctgtcttaatggatgacttttaatccttattttaaagtgtttttaactctgatgaccatttcaagtttcagttgaaaatactcaaatataccagccatagtattgtctgtagacaatattttctttttgttgtaagttttcctttctgtaagaaaatgatagtagagaccaattatgtactatggtttgtttaatgttctctggaagagtttatgaataa

SEQ ID NO: 378052 - DNA, 5371 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378053 - DNA, 5157 bp, Homo sapiens
aatcacttggagtcgggcgcgtcctacctaaaccaggcagtttatggcaaatacctgccttgaccgtgcttaaattagtgaacttttgggcaccaactggtcgatttaccatagaaattggtagttgctgcaaaaagaaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378054 - DNA, 5571 bp, Homo sapiens
cccaagtagctggggctatagtcacaggccaccacacctggctgatttttcaattttttgtagaaacggggtcttgtacgttgcctgggctggtcttgaactgttggtctcaagtgatccttccaccttggtctcccaaagcactgggattacagatgtcagccaccgggcctacctaagaaaaatatttaaatttaatatcagtatctgtggggaattggttccaggaccccctgaggataccaaaatccatggatgctcaagttccttatataacatggtatagtatttgcatataacctatacgcatcttcccacaaacttttaatcctctctagattatttatgatacctaatacgatgtaaatgctatgtaaatagttgttatatggtattgtttagggaacaatgccaaggaaaaaagtctacatgttcagtagagacacaacttttcattttctttcctgaatatttttgatacgcggttggttgaatccactatgcagaacccacagatctggaggacctactataatttaatttaattctaagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378055 - DNA, 5341 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaaaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatcgacgcgtgggtcgacccacgcgtccgaaaggactttttgcaaaataatgcttagttggagtttaaaaattcaggcaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtcaacaaagtatataaaatagtcttatt

SEQ ID NO: 378056 - DNA, 3164 bp, Homo sapiens
agaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctaaagctcgaaggagacttgaggctgtcgtttgtgctggtgttcctctagccacaggggctgctgaccggatcctgtccacgtggtccagccacacctcttgcggggctgtatgtgct

SEQ ID NO: 378057 - DNA, 316 bp, Homo sapiens
tattgggggtggggaggggaggggagtgaaatgatatacatttggaggcaccctcaggtaatcacactatagaaataatgctgctagttaagaggtttgttgcaaagatgtaaagcagcatgtacagaatttgttggacgtctgctttaggtataatttaatatctccacgtatcttttaatagactaataaaaaaccatagttaactacagttttcaaatagcaaataacatataatttagaggtgaggaatacagaagaaggtttttatctatacagtgtgacttacctaggtacgcaatctttaaacaaaatg

SEQ ID NO: 378058 - DNA, 308 bp, Homo sapiens
gattcttgaatatgctgcttgatatttccacgctaatatgaaatgatttactaatgaactcctgcccaggatgattgcaaacgttaactaatatctgattatttagtaccctataagtaaaaacagccatgagtaatgctagctgtataatagaagattagtaaatgttccttttttttttaaagaaattatttaaaattccttttaccccaatgggaaatacacagaggtgatactgtgggtttttaaaggattgtaataaatagcagattaagcacatagctatgataaataatagctgtcaatgg

SEQ ID NO: 378059 - DNA, 2097 bp, Homo sapiens
gagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtgcgcttgggttttgtgaaaggtgtgctttgaaaatacttggtttaggccgggcgcagtggctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgt

SEQ ID NO: 378060 - DNA, 240 bp, Homo sapiens
tgctgtttgtttgttaactgttaattattttccacaggtattagtcactgtaccactggctttactacagaaaggtgccattcagtttaatccaccgttgtcagagaagaagatgaaggctatcaacagcttaggcgcaggcatcattgaaaagattgtcttgctaatttccgtattagattttgggtacagtaaggtacaagggtctgacttttctgctcacgttcctctcctgtatct

SEQ ID NO: 378061 - DNA, 2983 bp, Homo sapiens
  misc_feature (2891)..(2891): n is a, c, g, or t
gagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggacgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagatttgtgcacccattggcaaaacaggaaagtttccagataggtattgtatcattgagaatgcagcacagatagtgtgggcttcacactatagacacagaatatagctttttcttaaagccaaatttgggtgataggacactttaaatatccttaattttggcaaccactagcaaaaaaacttgtcagaataatttaaccaagcccctctccacttcttttatttaaaagcactgattcaattgctaggaatatttttgcagatttttctttacagtattccataggcaggtccactggaaaactgcagaaaaatgtgagctctcctggtaaatagtatacattttataagctatattttaaaggcctaagaacatggcaagtatttacttttatcttttttttaaaaacactcatgacagaaaacagtttaataatatctcattctaaaataaaacactggttgcagggtcttcaggatgcctattttgccaagaaacttcagtatacaggttagaaatatgcttttgtttttgaacaataatatactggtttgctttaaagaagggactaaatatgactttaaagagacttcaaaatattgagtattttaaaaatttaaaagtaggtcagtttataacgagtaaatacctaacacaccaagaatgtgcagtgaacctcaggcatttaagacacctcccccaccgccgngcgtggatttgtaataaagttggttcctaaatagaccaatttttgtatgtttaagttacctcccaactctggttttgttattttttcagacc

SEQ ID NO: 378062 - DNA, 2431 bp, Homo sapiens
gagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggacgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgggcggcgccctttttttttttttttttttttttttttttgtttgttttttttttttttttttttttttttttatgttatattatgtttttttactttgttgtctactctctatttgtttttttttgtactagtacaccacacatcggctctggcttcttgatgaatgccagccagagatagttttttgctaccactatagatcaaagaattatcgctttgccaataaagaccacatttagcgctgataggcaactaacacatcccttacataggagaggcggaacgcacaaaaatgcagacgtattctgcgtgacaaaacaaaaacgtgggcggccgcatgat

SEQ ID NO: 378063 - DNA, 1405 bp, Homo sapiens
gagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggtttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttcaaaaaaaaaaaaaaaaaaaaattcggagggccacctaactgtcggggtgggggaagaagacgagggtccatgcgaagggggcacaatgggtcaaaacgcgggatcctgagacccaaggtttcctgggtcccaaacggggaacaactctgccgggtcctccccaataagagaagccgaataaatttcagaaaagccagtgtaaacccgggctgag

SEQ ID NO: 378064 - DNA, 3399 bp, Homo sapiens
gagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggacgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagatttgtgcacccattggcaaaacaggaaagtttccagataggtattgtatcattgagaatgcagcacagatagtgtgggcttcacactatagacacagaatatagctttttcttaaagccaaatttgggtgataggacactttaaatatccttaattttggcaaccactagcaaaaaaacttgtcagaataatttaaccaagcccctctccacttcttttatttaaaagcactgattcaattgctaggaatatttttgcagatttttctttacagtattccataggcaggtccactggaaaactgcagaaaaatgtgagctctcctggtaaatagtatacattttataagctatattttaaaggcctaagaacatggcaagtatttacttttatcttttttttaaaaacactcatgacagaaaacagtttaataatatctcattctaaaataaaacactggttgcagggtcttcaggatgcctattttgccaagaaacttcagtatacaggttagaaatatgcttttgtttttgaacaataatatactggtttgctttaaagaagggactaaatatgactttaaagagacttcaaaatattgagtattttaaaaatttaaaagtaggtcagtttataacgagtaaatacctaacacaccaagaatgtgcagtgaacctcaggcatttaagacacctcccccaccgcccgccccccgccccccccaatcaaagtgtggtcccaaaacaagccaacagctgtatatctcaaaagttaacccaagacaactctgatatttaggttatttgttgagactcattggtactgactggcaagtattctgctttaaagtatcatgtattaaaatgtttagacagcatgtgttttaaagtgataaatgcaaaatgttaagtttgaaatggttaacagtaaattattatgttagtttccaggcacttgaactgtgctacaagtaggggaaaacctactttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttca

SEQ ID NO: 378065 - DNA, 1192 bp, Homo sapiens
gagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggtttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttca

SEQ ID NO: 378066 - DNA, 2545 bp, Homo sapiens
cgcggagacttgtccgtcacgtgcggccgcccggcctctcggccttgccgcgcgcctggcggggttgggggggcggggaccaagatctgctgcgcctgcgttgtgggcgttctcgggaagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgatcttttcactagttctgtgcagatgaatcccacagattacatcaataatacaaaatctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagta

SEQ ID NO: 378067 - DNA, 358 bp, Homo sapiens
tgtaattgaaccaaagttttcttggtctcataaatacatatagtaaaaacaagtgtagttcagttgtctggtattcttaattaaagatactatggtctggttttttgattgattttttttttgttttgttgcttaataaattataacatagtgagaatgagtccctttggaaggaggtgtcagaattacgagcaaagcatgcacaacagcaacaagttattcgaaaggtaagaagctcttttccccaggaccataatttgcatttgtttaatgagtactgtttgtgacccaaaaaggtctttattgagtgtctgtgattgatcttagtttcttacatattggatgcacagatagaagt

SEQ ID NO: 378068 - DNA, 2491 bp, Homo sapiens
cgcggagacttgtccgtcacgtgcggccgcccggcctctcggccttgccgcgcgcctggcggggttgggggggcggggaccaagatctgctgcgcctgcgttgtgggcgttctcgggaagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagta

SEQ ID NO: 378069 - DNA, 2510 bp, Homo sapiens
ccggcccggcgtcgcgaggggaatcggcgagccgagggcgcgggagcctctttactgcacactcatcctccgtcctcccgcccggctcaggggttacaaatcgcggaggggacagggagcccagggccaggatcatcaacgtggggctttataggaggcgatctttacctcagcgaccgatcacccccagttcccccaacattgctttgcatctggcatctttatgtggagagcagtcagggcaatagacatacgttcaaacgcagacctttatgccttccgtttttcttttggcagtaactaagaaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagta

SEQ ID NO: 378070 - DNA, 1993 bp, Homo sapiens
tgtaattgaaccaaagttttcttggtctcataaatacatatagtaaaaacaagtgtagttcagttgtctggtattcttaattaaagatactatggtctggttttttgattgattttttttttgttttgttgcttaataaattataacatagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagta

SEQ ID NO: 378071 - DNA, 1341 bp, Homo sapiens
ctgctgcctccctctacagctcatggaggtttgtgagaacaagaggtttgtcaagaggtttgtcctcccagggtcagtattccatttagatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagta

SEQ ID NO: 378072 - DNA, 2760 bp, Homo sapiens
cgcggagacttgtccgtcacgtgcggccgcccggcctctcggccttgccgcgcgcctggcggggttgggggggcggggaccaagatctgctgcgcctgcgttgtgggcgttctcgggaagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtagttgagtactagtgtctgttatgtgtcttctttagaggtgacactcacatgaaacaattttttcttctcataggaagcagtagctttaaactgtctgtggttcattattctcaatatgaatcataccaagatatttgtgcctcatctcgaaaatatattgtatattgcaacaagggagaaatataatctctaaatttaatgtattttaaagttctttgtttaaaaattatactgggttgctttctatgtttctaataaaaaagtgagag

SEQ ID NO: 378073 - DNA, 2273 bp, Homo sapiens
cgcggagacttgtccgtcacgtgcggccgcccggcctctcggccttgccgcgcgcctggcggggttgggggggcggggaccaagatctgctgcgcctgcgttgtgggcgttctcgggaagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagta

SEQ ID NO: 378074 - DNA, 286 bp, Homo sapiens
ggttgagctgttggattatcttgacagtattgactgcagtttagaggacttccaggccatgctatcaggaagacaatttagcatagacccagatctcctggttgatgtaggtactttgggtaatctttgctatactggtagtttgtgtgtttatgtatattatttaaaaaccagtacgtcattttgttttgtattctacaggttgtttttgcatttcttttttaaattaataattttgtttatcagaaagaatgaaaaaataggtttgggacattgaaggagtatg

SEQ ID NO: 378075 - DNA, 1062 bp, Homo sapiens
  misc_feature (1062)..(1062): n is a, c, g, or t
cgcggagacttgtccgtcacgtgcggccgcccggcctctcggccttgccgcgcgcctggcggggttgggggggcggggaccaagatctgctgcgcctgcgttgtgggcgttctcgggaagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagtaattttttagttagggtctattttatatttattgtctcagactaaattttattatggcagtgtttcatgcattcaaagaagtgtggtgaataacaattcaagtgttcatcccacagctttgttaaattgtgacattttttattatttgctttagattattgtaagaaataaatcatcacaaatcn

SEQ ID NO: 378076 - DNA, 2467 bp, Homo sapiens
  misc_feature (12)..(12): n is a, c, g, or t
  misc_feature (16)..(16): n is a, c, g, or t
  misc_feature (27)..(27): n is a, c, g, or t
  misc_feature (32)..(32): n is a, c, g, or t
  misc_feature (35)..(35): n is a, c, g, or t
gggaccttgtantacngaactccactnattanggngcggaattccgcgagcttgcattctgtcgggtggcgctgtatctatcatcatactgtagacagcaacgcgatccatctcgaacggtcggctacgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagta

SEQ ID NO: 378077 - DNA, 2103 bp, Homo sapiens
ttgcctctgttacctggtataagataaatgttgcctatcaaacaccagttttctcttttgcaccgtagtgtaatcttcaaagtacttgaagtaaaaaagttgggatctatagccaggcaagtttggtacttatcaccaaaacaaataaactgcctggaagctggtatgtttctttagacggtggttctacggtgcgtctggatttcaagtgttaatatgtgagaaattatgagacttagaggacaaattattatatgaatttgttttataagacttggtaatagagacaaaagaattaacagtataatgaaataatttttgtttatatttttttcagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagta

SEQ ID NO: 378078 - DNA, 2907 bp, Homo sapiens
cgcggagacttgtccgtcacgtgcggccgcccggcctctcggccttgccgcgcgcctggcggggttgggggggcggggaccaagatctgctgcgcctgcgttgtgggcgttctcgggaagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtaaaaacacaacaacaaaaaataataaaaaaaaaaaaaaaaaaaaaaaggggggggggccctcaaaatttccccgggggggccccattataggatgtatccccagtgttgtgttgaccacaagggggcccccaaagagagaacagataataaaacagaagagcacgagacgcgcatttatacacacggttctgtgcgtgggaacacaatgtatacgtagagaacactttagggagaaaaaccctattacttgggggggcgagcacaatgttgggcacaccattccccacaaaaaaatttatacgaccctgagggacaattataacactttcgcggtattatgtggttaaccagcagcgataatttctcgtgttgtaataaaaatttggcacacgagtattattttgaacatttttcag

SEQ ID NO: 378079 - DNA, 2547 bp, Homo sapiens
cgcggagacttgtccgtcacgtgcggccgcccggcctctcggccttgccgcgcgcctggcggggttgggggggcggggaccaagatctgctgcgcctgcgttgtgggcgttctcgggaagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtatgatgcggccggtccttttgttcgtatattttctatcattcaaatattgttaggtt

SEQ ID NO: 378080 - DNA, 716 bp, Homo sapiens
tgaggcagtctcattctgtcatccaagctggagtacagtggctcgatcatagttcactgcagccttgatctcctgggctcaagcaatcccccaacctcggcctcccgagtagctgggactacaggcgtgcaccaccccctgcttggttaactggtagcagttgagtcatatttccttcttgtcttttttcttaagtgtggtttctatttgttggcgattttgctgtgtggtagagtcgtgctcaccctgcacccacgtgggcctttcttagcttaaaatggagaacatgccaccacctgcctgactgggctgatgtgagtatgaaaccaggtagggcatggaaagcccttgctttggtgttaaatacacaggggtgctgtgtatttaatatattcctcctacaagaaaaggaggggctgggtgaagtggcccacacctgaaatcccagcactttgggaggcacaggcaagagtattgcttgagtccaggagtttgagaccagcctgggcaacatagcgggactccatctctacacaaaaatacaaatattagccaggcatggtggcatgcacctgtagtcctggatacctgggaggctgagatgggaggatctgggaggatcgcttgagctcgaggaagtcaaggctgcagtgaacgaagatcatgccactgcactccagcctgggctggacagagtgagaccccatctcaacaaa

SEQ ID NO: 378081 - DNA, 434 bp, Homo sapiens
taggttatgttgattttattcctttgagaactgattacccctcaggagtgatcaagatgggcttgtgtggggtggggccaaagggagaatggcaggcaaccattcagagaaagtggttttaccatctcgaggtgagtaatgtttaaagttttagctgctgtgaagtgggatgctataaaattcgggggagttttccttctacccggtttcattccccgctcccctagccccatgcaactgcatttcccctcttctgtgctgagggaaagaaaagctgcctctcctttcttggttttgtagcatggcttccagtacctgttagtcatctccttgctccttttttattttttttgagacagagtcttgctctgttgccaggctgcattccagactgggtgacaaagggagaccctgtctgaaaaggaaaaaaaaaa

SEQ ID NO: 378082 - DNA, 1230 bp, Homo sapiens
taggttatgttgattttattcctttgagaactgattacccctcaggagtgatcaagatgggcttgtgtggggtggggccaaagggagaatggcaggcaaccattcagagaaagtggttttaccatctcgaggtgagtaatgtttaaagttttagctgctgtgaagtgggatgctataaaattcgggggagttttccttctacccggtttcattccccgctcccctagccccatgcaactgcatttcccctcttctgtgctgagggaaagaaaagctgcctctcctttcttggttttgtagcatggcttccagtacctgttagtcatctccttgctccttttttattttttttgagacagagtcttgctctgttgccaggctggagtgcagtgcagtggcaccatctcggctcactgcaatctccgcctcctgaattcaagctatctcctgcctcagcctcctgagtagctgggactacaggctcacaccaccatgcccagctaatttttgtatttttagtagagacagggtttcaccatgttggacaggatggtctcgatctcttgacctcgtgatccgcctgcctcggcctcccgaagtgttgggattacaggcgtgagccaccgcatccagccctccttgctcccattttaagtgccggtggatttggaaagatggatatgtagtctctgggatcattgtctttgatgtatttagagcttagcagctgtcctgtcagcccgagccctgtgtcactcggcatctctgccaatgttactacgtcccaagaagcttttcaggtggcttccaggtctgtattggaagcaatgacctacctgtgttgtgagatatcccaggagccagcctctgtcactcacaggcttccagattgctctgccctggcctggggtctctgtctgaagtagagcatgaaagcagccggccccaaccctgcagggtacacctgagcctttgactccgaggaaggaaatggcgatggggggatgcagggatgatgaggaaaggcctcactctttgagtgtgtgatgaaagggaaaggatgtcaggaaggcactgagcaaaaggctgttacagctgaccttgagaggtcagccaatccattagctgcatggggcccagagagggtgaagttctttcatgagatcatgcagcaagttagtgtcaagtctagaattagaacttgggtgtctttgaccctgacagcgggag

SEQ ID NO: 378083 - DNA, 438 bp, Homo sapiens
cctgggcgacagagcgagactccgtctcaaaaaaaaaaaaagaatgttatcatgtttccggaaaggaaatatttaaagctttgctataataggtggttgaatgcaaagaaaaagacatcatagtcagtctccttgtgctaaaaactaaaatctctccctgttcctttagagctgatctctccatctcagccgctcttgacactggggctgcgttgtctttgtcctggggctgtcctgttgggttgtaggctgtttggtgccattgctgtcctctctcatgagaagccagcagcactggtgtgcagtaggcaataaaaaatgtctggaaggacatggcagtggtccctgaaaggcaacatgggcctaggatgagaacccctgacatgagattttaaccataagcagccagcttcaggctgtaagcatgagatccctccc

SEQ ID NO: 378084 - DNA, 254 bp, Homo sapiens
ttaaaaaaaaaaaaaaacaaaacaaaaaactgacagtgtcaccggacgtcttcagtggcttctcacccgtcattcccacctgagcctgccagagggcgctctttggtcttctaccctcaattttgtgtcaccgtgaattaaaccagctcatttgaaaggaggaaaaaaaaagtgtcttctttttaaaatcattgcttttggccagttgtggtggctcacgcctctaacccagcgctttggagtccaaaaccggc

SEQ ID NO: 378085 - DNA, 700 bp, Homo sapiens
aaccctgctgaaatattgtcctactgggtagaagtctgaatcataaaaattccaaaagttgcccctaacccttcccttcggctcccctctcacttgttagagcaacccagtacactgctttcctaatggatctagactggaaatctgactaaccatcaccttcacagtgaatatccttcaacagggccctcctgtcctcaagaaaaactcaagcctctgtgaccagactctgccagctactgcagcctcctctctctctctgccaccagctcaattgtgtcaggctctaagaagatggagtatagcttataaagagccaggcacatcatactgtttctgtatgctatccctttgctcctgtggttttccctgtgtggaatactctctcctattattctcaccctttaagactcaggacagtcattctcttgtacacagagccttccgtgaccacgagcttgctattgcaccagacccaaactatcaaaataccccaaccgctgctatcataccagaaccaaagtaccaagtcacaggacttcaccctgtcaggttaaatgactgccaacttacatagcactcaccaggtgccaggcagttttttaagcacttttcatatatcaactcatttagtcctcataacaacctacaagcagatattattactattttttcttttgtggataaggacacagaggca

SEQ ID NO: 378086 - DNA, 1071 bp, Homo sapiens
atgaatggggtctcggaggggaccagaggctgcagtgacaggcaacctggggtcctgacacgtgatcgctcttgttccaggaagatgaactcttccggatgcctgtctgaggaggtggggtccctccgcccactgactgtggttatcctgtctgcgtccattgtcgtcggagtgctgggcaatgggctggtgctgtggatgactgtcttccgtatggcacgcacggtctccaccgtctgcttcttccacctggcccttgccgatttcatgctctcactgtctctgcccattgccatgtactatattgtctccaggcagtggctcctcggagagtgggcctgcaaactctacatcacctttgtgttcctcagctactttgccagtaactgcctccttgtcttcatctctgtggaccgttgcatctctgtcctctaccccgtctgggccctgaaccaccgcactgtgcagcgggcgagctggctggcctttggggtgtggctcctggccgccgccttgtgctctgcgcacctgaaattccggacaaccagaaaatggaatggctgtacgcactgctacttggcgttcaactctgacaatgagactgcccagatttggattgaaggggtcgtggagggacacattatagggaccattggccacttcctgctgggcttcctggggcccttagcaatcataggcacctgcgcccacctcatccgggccaagctcttgcgggagggctgggtccatgccaaccggcccaagaggctgctgctggtgctggtgagcgctttctttatcttctggtccccgtttaacgtggtgctgttggtccatctgtggcgacgggtgatgctcaaggaaatctaccacccccggatgctgctcatcctccaggctagctttgccttgggctgtgtcaacagcagcctcaaccccttcctctacgtcttcgttggcagagatttccaagaaaagtttttccagtctttgacttctgccctggcgagggcgtttggagaggaggagtttctgtcatcctgtccccgtggcaacgccccccgggaatga

SEQ ID NO: 378087 - DNA, 575 bp, Homo sapiens
gagctactgtgcctggcctataacaacttttatatcactattttggcaagaatagtatgcaaattctgtctttccaccattgtgaggggttaatattattagccaatatttatagttactgatagtttagaaaactttcagcttcaaactccattattgataatgccatatgtatttttagaatcttcatcaaatctaaaaaaaactctagttccttttttatatataagctgtaagatttctggcatttcaagttttcttgtctattgacttattttaaatgctaacgcccactaaccagtgtgacgctgatgttttttatggtgaattaggagtgtatgttatctttgctaatgtcagatttcgtgccatgtcagcaagaaagttaataaacgcctaagcaagagcaaagagcatggcccagcaaaggaagaagtgccctttggctggagcatggtgtaaagggagatctagaggggacataacctagaaaggtgtgttaaagccaggtcggacacgagttgtagtgccaaatgctgttggtggttgaggatagactatcatgcctctcagtt

SEQ ID NO: 378088 - DNA, 362 bp, Homo sapiens
ttaaaggagaggttcatgacagtattactaactcaagattctcactccgttttccttaaagtaagttctggttgggtgtggtagcccacacctctaatcccagcactttgggaagctgagggtgggaaaatagttttgggccaggagtttgagaccagcctggtgaacatagcaagactctgtctctacaaaaataaaaacattagtccagtgtagtggtacatgccagtcagtattcatagctactcaggaagctgagggaggaggaagtcttgagcccaagagtttgaggttacagtaagctatgattgcaccagtgcactccggcctaggcgagaaagcaaaactctctttaaataaat

SEQ ID NO: 378089 - DNA, 391 bp, Homo sapiens
agtagacatttattaggaggtggagaatctggttgatggcttttgtttttgatttggagatagggtctcactctgttgctcaggctggagtgcagtggtgcaatcctagctcactgcagcctcaaactccttggctcaagtaatcctcccacctcagccttcctagtgtctgggtggcatgcaccagcctggtgaacatagcaagactctgtctctacaaaaataaaaacattagtccagtgtagtggtacatgccagtcagtattcatagctactcaggaagctgagggaggaggaagtcttgagcccaagagtttgaggttacagtaagctatgattgcaccagtgcactccggcctaggcgagaaagcaaaactctctttaaataaat

SEQ ID NO: 378090 - DNA, 446 bp, Homo sapiens
ggcttggcctctctagcctcagtctccccatctgtcagacagagctaaaaccaccacctctcacatgggcagactcagcaaggatcagcttgcaagggaggtgtgaactctgcagagatcttcaatgtcattctcacctccaacctcatctcagccctggacgggtaacagcgaaggaggcccagagagggggattggctcatctagggtcacccagccagtgggggcagagtatccacctggccagggttttttccacttgcccctgtaacagacagggcggggagccagctggcagcctgggcctgggggacctgcgggggtggggaagatccgccctgtcccctgaggggtcagtgtccagtgcgttggaacacagctgtggagcagaggaaccacactcagagtttccaccccacgtggtgggtgggaggacagtgatagct

SEQ ID NO: 378091 - DNA, 367 bp, Homo sapiens
cccactgtccattttgtgagggttgatacagacagaacaaggtgcctgggctactcgtcggtgctggtcaggtctaaagataccgcatggaaatccggtgcccctgggatgagcaccccaccatggagggcaccgctctgggcctgcgtgcctgtggaggcccccttttccggaaggaggagccaaagggaaagttcgttctgatcagttgggctgctctgttctccagtgattatgtccatttaaggtgtttccctgttggcctctacagtaacttcacagctcagaagctctgccacatggacattttccacactttccagcagtttatatcttgatttcagagcatactcagaaatgtgcctgt

SEQ ID NO: 378092 - DNA, 426 bp, Homo sapiens
catgtctgtctagactctgcagccccgctcctgctacccgaaataatgcccacctcccagggtagctataaagcttttgagacaccgtctgcagcgtggccccaaaatgcctggagtgtaagaactcagtgtgcagtaacttctttctttccctttctctgagcaaaaaagaaatcttaaaagaaagtgaaaatctgttgccttggagaagtttgagaaggaaccagaaagtgtgtgggaaggaattcgctcagcctgggctgccatgccggttctggtgggttccacctccgagcgtcccctggctgatgggggcatttaaccacctcctccaggttttgtttcccccacttcacccacatggaacagcagttctcacaggcagacgggctggtgagttagcatctttccatgatgaactgtgct

SEQ ID NO: 378093 - DNA, 855 bp, Homo sapiens
gctagctataacttaggaaaatagatttttcaatggaaagcaatagataaaatatgtagaaggtaccatttaatgttctgtgctatcttatgttattaacctcaacaaagcacctaaaaacagtattttcttatgtaagaaggattgtaatataagcatttctatttatgtctagcaatctgagtgtttttgtaccattttaatgttttatatttaagagactatgacaaaatatagaatatcatgctgaagcactagttaccaagctacagaaacacatcggattcaatgaagtccctttgtttatatgtagatatatacagattcatgtagtataggatttagcaatgtgcctaagtcaagaaagcaaaaggcagtgggggattagaggatagggaaacaattattctagatctgagatagtatcccaggcaattaatggcttcagatatgtcagaggataatgtgtccttcagcaatactatttcatctaatcagccagaatcctaaactatctcttgagactacttgaagtagtcttgagttattaatatgttaaccaaaatggtggcagagtagaaaatctcttggtgatgaaatcaaatggccctacttgacgttcattattgaatcataatggtccttctgaaaaatccctgaaggaggaaggactttaaaactttgcacatgagcctcttatttaataatattgtgccctccaaatttcaatactttcctgacagaattccagcattattggcctcggatgagatgggggttaaggttaagcaattggtagaaattgatgtggagctgtcagaaccagaactcaaactcaggtctatcaagcacagg

SEQ ID NO: 378094 - DNA, 111 bp, Homo sapiens
gtacaaccacccctaaagctcagttttgaagtgagtgtatttatagcttctctgctggtgctgccttctagagggatgatagatcatttgaacccaatgacaatttttaac

SEQ ID NO: 378095 - DNA, 761 bp, Homo sapiens
aactaatatgaagaagtctgtaaacttttcagaaagcaccaattgtaaagtcttgtgaaagcaccaatatgaagacctaaaccaatgaagactcatacaacatttctgggtgaagtgacttcagtaataacaataatgtcaaatatctccaaatagttaactcattttcagccagaatgctattttttttagaggggagtcaggtaaaattaaagttcatgtggtggaacatattccaaaagagccaagaaaacaaagaacaaagagcagaatgagacatgcttaatagatactcaaactttctatataccctgtataatcaaagcagtatgatatgacgtttttatcctaattgcctcactttacaaaattgtaatattaccaatatactgtatatctgcttgtgtatttttttgtctatatatctgcttatgtactttatacataagctgataagcaacttcagcaaagtcttaggatactgaacatctgtgatttatacctgaaaagaataaatcgcaataaatcattggatttcttgatccacccagaactcgtttttgacccttggagggcaatgtggcccctgttgagaatgcatgatttaggggaaaaagaataattgattctacaaatgctactgatataatttgatatctgtcaagaaggaaaaaaagtgaaacctctgttcacaccataaacaaaatggattaaatatttaattgaagagaaatagaaaataaaaattataaaaaaaaaaa

SEQ ID NO: 378096 - DNA, 471 bp, Homo sapiens
ttaaaaatgagccaggcatagaggcatgcacctgtagtcttggcactcaggaggctgaggtggaaggataacatgagcccaagagtttgaagttacagtaactatgatcatgctgctgtattccagcctgggtgacagaacaagacactgacttaaaaaaaaaaaaaaaaaagacatttacaagaatgctatggcaacgttgtttataaggacaaatacaagagaaagatataataaatacttattgacaggggaatgaataaagatggcacagttatacaaaacatatacaatattgagtaaatacacaagacatataaggatgccatgacatacacaagacatacacagccagccatggtggctcacacctgtaatcccagcactttggaaggctgaggcaagaggatcacttgagctcaggagttcaagaccagcctgagcaacatcacaagaccttgtctctactta

SEQ ID NO: 378097 - DNA, 391 bp, Homo sapiens
tgtcgttatcacctaaagaccatggtttacgttaggattcactcttggtgtggtaccttttatgggtttgtacaaatatataatgacatgcattcatcatgataggatcatactagataatcttttagaatttctttttgttagctaagtcttctgatttttctaaaatgaacatgtggccaggagtgatggctcacgtctgtgatcctagcactttgggaggccgaggtgggtggatcacctgaggtcaggagttcgagaccagcctggccaacatggcagaaccccttctctactaaaagtacaaaataattagccgggcatggtggtatgggcctataatcccagctactcaggaggctgaggcaggagaatcgcttgaaccctagag

SEQ ID NO: 378098 - DNA, 506 bp, Homo sapiens
gccctactacatgtcatatgctgttctagttgctggaaacacaaatgtgaatatggtaggcctgcccttaaacaatgaattacagtgtaaaatgaaccttttataaagctggtcctatatcaatctaattattttgtttttcttcatttcaggcctaagacagctttattttctttccactccaaatgatgaagaatccccttagggcaaagaaggaatttctgagcatgttataaaaaaatagaaaataggataagttgcgtgaagatttaatatttctatacatcaaaacctaccataaacaaaattaaaaggcaaatagtaaacttggaagaacatttgtaacataaaagacaaaagtttaatatcataataaaataagcacatagtagcttttagtaaatcattgctgaatgaatgaatacatatatgaattcaaagcaatgaaaaaatcaccccaggaaaagatgtaaacatttgacataggacaagtcaccaaaaaaaaa

SEQ ID NO: 378099 - DNA, 717 bp, Homo sapiens
agtatacgacgagaactaagcttgacgtgaatcggcagactctaatcccagccagcattgcgaggggcctgatagctgcgcgcttgcggagggtcagtcgggcgtcgggagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaagcaagatcgtgttttcttaaaaaacaagacaaacaaataaataaataaataaaagtgtataaatttgtttcattactgcagttgcactagttacatttctagcactcggtagctctaccggctgccatactgaacaatctgcattggcagattaagaagtttcatcatcacagaaagttcaactgggcagtgctgtttcggaaggtcccttgggcactgggcctctg

SEQ ID NO: 378100 - DNA, 2584 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378101 - DNA, 1339 bp, Homo sapiens
gcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtgaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378102 - DNA, 2628 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagaggtgctaacggatggaagggttgtttctacctgttggccattgtggatgatgttgctatgcatattgggaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378103 - DNA, 1553 bp, Homo sapiens
ttgaagggggtgtctccttcaagagaaagtagggaagtatggaggtgataggaagggagaggcctgagaggagctagtttggggagatctcaagtatcccaaaggagccactgatgttccaaattatccttggtaacgtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378104 - DNA, 2854 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378105 - DNA, 2636 bp, Homo sapiens
  misc_feature (1492)..(1492): n is a, c, g, or t
  misc_feature (1509)..(1509): n is a, c, g, or t
  misc_feature (1512)..(1512): n is a, c, g, or t
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgcccggacggggcccccccccgggncccccttttccctttgnccntgggtctggggccaggccctgggtggtttgcctaggggccctggctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378106 - DNA, 2608 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtt

SEQ ID NO: 378107 - DNA, 2642 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378108 - DNA, 857 bp, Homo sapiens
tccaagcgcgctcacagtggggaccaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378109 - DNA, 946 bp, Homo sapiens
ccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378110 - DNA, 2348 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaagctacagcacatgccggcatgtgctgtaggccagcgacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttagggccttaggcactggctttgttcatatgaccgacgctgcctaca

SEQ ID NO: 378111 - DNA, 691 bp, Homo sapiens
gaatggtaaccttgtccttcacgccagcgaaatccaccatccgctgggtgatggcgtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378112 - DNA, 704 bp, Homo sapiens
agaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378113 - DNA, 375 bp, Homo sapiens
gaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgc

SEQ ID NO: 378114 - DNA, 1368 bp, Homo sapiens
gcgaggggggaaaaaaaataggctaggtacgaggctgggtgttgttgcatccgagggttgatcggatggtggttcccatccagatccaagtcctggcccctgatcacagagaaacacagctggacattaaagtgaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtt

SEQ ID NO: 378115 - DNA, 2560 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378116 - DNA, 2739 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaaaaaaacaaaaagataaaaaaaaaaaaaaaacccggggctttatttggggggggggaaaaaggggtttcggcaagggggcctggctacatgtgttttcctgacccagtttttggccacaggggggtaaatggggggccccattagggggcggataaattgaaaaccgggttaccggta

SEQ ID NO: 378117 - DNA, 1320 bp, Homo sapiens
gcgaggggggaaaaaaaataggctaggtacgaggctgggtgttgttgcatccgagggttgatcggatggtggttcccatccagatccaagtcctggcccctgatcacagagaaacacagctggacattaaagtgaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378118 - DNA, 1476 bp, Homo sapiens
tgtctttccctgctgctcccccacgtgggggagaacacgtgggctgagaaaaaaaaaacagcatgtgcaaacctgacagatgtcacggctcccaacattgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378119 - DNA, 2545 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378120 - DNA, 2381 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggagaatgtggcagcatgcgcaagggaccctgccaccgggctgaacacgagaacatgccaggagaccagcattcctagacacgtcacaagacgcacagcatgacatgcacaactacacaacggcgggcaacacgaagcagtgggacgcacgaacaagccaacaaaggacaagaaaaaaagccgacagcccggacccacagagaaaccaccagggtagacggaccaacacagaaaaaaagaacgagagacaaaaacacgccagagacagacacaccaaacaaacaaaaacacacaccacgcacccc

SEQ ID NO: 378121 - DNA, 2469 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378122 - DNA, 1635 bp, Homo sapiens
ttgaagggggtgtctccttcaagagaaagtagggaagtatggaggtgataggaagggagaggcctgagaggagctagtttggggagatctcaagtatcccaaaggagccactgatgttccaaattatccttggtaacgtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378123 - DNA, 969 bp, Homo sapiens
gcgaggggggaaaaaaaataggctaggtacgaggctgggtgttgttgcatccgagggttgatcggatggtggttcccatccagatccaagtcctggcccctgatcacagagaaacacagctggacattaaagtgaaataacatctgctttgctgccgagctcagaggagaccccagacccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgccccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataaaaaaaaaaa

SEQ ID NO: 378124 - DNA, 1980 bp, Homo sapiens
ccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctatggcccacaggacggtgtcaaaggtgcccgtgtcctccttgccggtggtgctgtcctcccaggtgacctgcagctggccatcagggagcctcctgacccgcgaggggcacagcccctcaggaaccgggtgccatgagatgccatgtgctctatgaccatggaggacatttgctggtcgaagccgcggagggggatgctgcgcatcatgatggtggtgtccagcccaatcccggtgaggaagccagcacactccagggccacatagctggccccgaccaccaacgtttttccaggggattccttcagccagaagatgtcatcacttgtgattccatattccaaggcaccttcgatgtgcgtggggtatctcggccgccctccagtagcaatgatgatgtgatcggctgacagcagaatctctttcccacctttggcaacgccgcaaaccgtgtgctcgtcaacaaagctggctttgatgttaaagtacttgacttttctgtcctgaagctggacacggtggccccagttcaaggatttcacgtgattttgaacagcttctgccatcttcctccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgccttggggagaaggttccacgtagtccaccacggacaccttccttcccagctgagcggcctccttggcacaagccaggccaccagatcccccgccgaccaccaggagatcatagtcccgctgacctgctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaagcaagatcgtgttttcttaaaaaacaagacaaacaaataaataaataaataaaagtgtataaatttgtttcattactgcagttgcactagttacatttctagcactcggtagctctaccggctgccatactgaacaatctgcattggcagattaagaagtttcatcatcacagaaagttcaactgggcagtgctgtttcggaaggtcccttgggcactgggcctctg

SEQ ID NO: 378125 - DNA, 726 bp, Homo sapiens
gcgaggggggaaaaaaaataggctaggtacgaggctgggtgttgttgcatccgagggttgatcggatggtggttcccatccagatccaagtcctggcccctgatcacagagaaacacagctggacattaaagtgaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatcta

SEQ ID NO: 378126 - DNA, 231 bp, Homo sapiens
aggacggaactggctggctgtggaccccacgcctgggaatgcatccatctggtcacccagctgcaggtctcctgacctgcaccctacaccaaggacgcggggtggccctaggttcagaaggtcttggctaaaatccgagctcttgggacagacaagccatcttgcctcactgagcccctgttccctcatctgttcacaaaacaaatagaaacaaaacaacattcaagccag

SEQ ID NO: 378127 - DNA, 421 bp, Homo sapiens
gagactgctaatgggtctccttttgggatgctgaaactctggaactagatagaggtggtggttgcacaacattgtgaatatactcaatgccactgaagtgaacactttaaaatggttaaaatggtaaattttgtgttatatgtattttactgcaataaaaaaagtgagaagaagcggtagaatctagatggtgaatatatggatgttcattataaaatgttttcaactttgccatatgcttgaacactttcatcataaaacagtgagagagaggccgggcacggtggctcatgcctgtaatctcagcactttgggaggccgagatgggtggatcacctgaggtcaggagttcaagaccagcctggccaacatggcgaaaccttgtctctactaaaaatacaaaaattagctgggtgtggtg

SEQ ID NO: 378128 - DNA, 159 bp, Homo sapiens
cattttagggtttcataagaattctagttaacatgtaattctgtatacaaaatgtgccggaaaaggttatgttattaggattatgttattagtacctccccagactccaaagagacaaaaacaaacaaaaaaattttgtctatttcagtagttatccaa

SEQ ID NO: 378129 - DNA, 419 bp, Homo sapiens
cagaaaaaaattaggctgtcagtaaatgtatgaaaatatgtcctgtcagagaaatgtatattgaaacaatgggatgaatttttcttttatggaataggcaaggtattaaaaaatgataatacttaggccaggcatagtggctcatgcctgtaatcccagcactttggaagactgaggcgggcggatcacctgaggtcaggagttcgagaccagcctggccaacatggtgaaaccccgtgcctaccaaaaatacagaaattagccaggcatggtggcacatgcctgtaatcccagccactcgggaggctgaggcaggagaattgcttgagcctgggaggtggaggttgcagcgagctgagatcgcaccactgcactacagcctgggcgacagagcaagactctgtctcaaaaaaaaaaaa

SEQ ID NO: 378130 - DNA, 273 bp, Homo sapiens
ggccaaaccccgaagcttgtttctatagtactgaggagccaagaaaattgttacattttttaatggttggggaaagatcaaaagacgaataatatttcatgaaacatgaaaattatattagccgggcatggtggcgtgcgcctgtagtcccagctactcgggaggctgaggcaggagaatggtgtgaacctgggaggcggagcttgcagtgagctgagatcacgccactgcactccagcctgggcgacagagcgagactctgtctcaaaaaaa

SEQ ID NO: 378131 - DNA, 294 bp, Homo sapiens
agggtttcgccatgttgcccaggctggtcttgaactcctgagctctagcaaatcttcccaccttggtctcccaaagtgctaggattacaggtgtgagccaccgcacctggacttctttttctttttttgagataaggtctcactgtgtcacccaggctggagtgcagtggcacgatcatagctcactgcagccataagggagtaaaggaaagaacacccctcagccccctccactcccagcatcccacccacctgctgaggtcccacttgggtccctgtgcccaggaaaccccg

SEQ ID NO: 378132 - DNA, 724 bp, Homo sapiens
ggtgcttagtacataatgaatgagtgaatgaacaaattcaattctgtaagtatttatcatctccttacacggcaggcactgttttaagtcccaaagaaagaggcagaggagcgacagagatgacttcctcccttgaaaacgaagcatgtggcctgacaacctaaaattggggtcaatccatccaattatggtgactgcttagaaatatcccttttcctcccaacgttttcctttccttctcccataaacataataatgtctcctgccagtactaaggcatggcccatggacccactaacacctatgctcacgttagctcttgaggccgagtggcttggttctatctggttatcagatgcaaacttcatcacagcagggatttgggctagacattagaggaatagtgtggtaccagatggtgtttctgaagaaggttgtcctatttttgcagtttaaggatttgataataaatctgcctggcagccctcagatgtgatttggccttgaaatcgtctctgttaatccttgatgctgtgtgtatctgtcaaggtccaaccagaaaaaacagaacctgctctaagtatctgaacaaagggaaatttaatgtaaggagctgattgcacagatgaaggaaggggctgggaggcaaacaagagggaactgtgaggtaacccagggatttgccacagtaggaagacatgaccactactaggatagagaggta

SEQ ID NO: 378133 - DNA, 402 bp, Homo sapiens
tggagctgcagatccctctcctgttcaaactatgagagctggctcaggtcccctgctatagtgggccagaaaagcctggacttccactgctttttcctgcagagctgagtccctccagggctgccatgagaggcggggagagagagcactagacagagaagaccagaagaccatttgagaattcctttgggtttccttcatgattcctttttcttctcattctgaattgttttattttattatgtaatattcggtatatgcaaaggaatatatgacacctttgtgtgtattacaaaacaagcatttgagaatccgcacctctccacccaatttttctttgtggtttctttgccagtaaaagagttcactcatctgttgcttaaaatataggatgcttgagtc

SEQ ID NO: 378134 - DNA, 2003 bp, Homo sapiens
ccgggtgttatttcagtcacgggggggagttgacggaacgtgaggggtcgtgaggaggcgcgaatcaagttagcggggggaagagtcttagacctggccagtcctcagggtgagggccctgaggaagaactgagggacctcccaccatagagagaagaaaccccggcctgtactgcgctgccgtgagactggtgctccaggaaccaggtggtgacgaactgggtgtgaggcacacagcctaaagtcagcacagcagaggaggcccaggcagtgccaggagtcaaggcctgttggatctcatcatccatatccctgttgatacgtttacctgctgctcctgaagaagtcgtcatgcctcccgttccaggcgttccattccgcaacgttgacaacgactccccgacctcagttgagttagaagactgggtagatgcacagcatcccacagatgaggaagaggaggaagcctcctccgcctcttccactttgtacttagtattttccccctcttctttctccacatcctcttctctgattcttggtggtcctgaggaggaggaggtgccctctggtgtgataccaaatcttaccgagagcattcccagtagtcctccacagggtcctccacagggtccttcccagagtcctctgagctcctgctgctcctctttttcatggagctcattcagtgaggagtccagcagccagaaaggggaggatacaggcacctgtcagggcctgccagacagtgagtcctctttcacatatacactagatgaaaaggtggccgagttagtggagttcctgctcctcaaatacgaagcagaggagcctgtaacagaggcagagatgctgatgattgtcatcaagtacaaagattactttcctgtgatactcaagagagcccgtgagttcatggagcttctttttggccttgccctgatagaagtgggccctgaccacttctgtgtgtttgcaaacacagtaggcctcaccgatgagggtagtgatgatgagggcatgcccgagaacagcctcctgattattattctgagtgtgatcttcataaagggcaactgtgcctctgaggaggtcatctgggaagtgctgaatgcagtaggggtatatgctgggagggagcacttcgtctatggggagcctagggagctcctcactaaagtttgggtgcagggacattacctggagtatcgggaggtgccccacagttctcctccatattatgaattcctgtggggtccaagagcccattcagaaagcatcaagaagaaagtactagagtttttagccaagctgaacaacactgttcctagttcctttccatcctggtacaaggatgctttgaaagatgtggaagagagagtccaggccacaattgataccgcagatgatgccactgtcatggccagtgaaagcctcagtgtcatgtccagcaacgtctccttttctgagtgaagtctaggatagtttcttccccttgtgtttgaacagggcagtttaggttctaggtagtggagggccaggtggggctcgaggaacgtagtgttctttgcatttctgtcccatatgggtgatgtagagatttacctgtttttcagtattttctaaatgcttttcctttgaatagcaggtagttagcttcagagtgttaatttatgaatattagtcgcacatgtattgctctttatctggtttaagagtaacagtttgatattttgttaaaaaaatggaaataccttctcccttattttgtgatctgtaacagggtagtgtggtattgtaataggcatttttttttttttttacaatgtgcaataactcagcagttaaatagtggaacaaaattgaagggtggtcagtagtttcatttccttgtcctgcttattcttttgttcttgaaaattatatatacctggctttgcttagcttgttgaagaaagtagcagaaattaaatcttaataaaagaaagccccactgactcctt

SEQ ID NO: 378135 - DNA, 1887 bp, Homo sapiens
  misc_feature (29)..(29): n is a, c, g, or t
atacctaggctaacgtcggaccggcttantcggccgaggaagaacccgggctggtaatgcgctgccgtgagactggtgctccaggaaccaggtggtgacgaactgggtgtgaggcacacagcctaaagtcagcacagcagaggaggcccaggcagtgccaggagtcaaggcctgttggatctcatcatccatatccctgttgatacgtttacctgctgctcctgaagaagtcgtcatgcctcccgttccaggcgttccattccgcaacgttgacaacgactccccgacctcagttgagttagaagactgggtagatgcacagcatcccacagatgaggaagaggaggaagcctcctccgcctcttccactttgtacttagtattttccccctcttctttctccacatcctcttctctgattcttggtggtcctgaggaggaggaggtgccctctggtgtgataccaaatcttaccgagagcattcccagtagtcctccacagggtcctccacagggtccttcccagagtcctctgagctcctgctgctcctctttttcatggagctcattcagtgaggagtccagcagccagaaaggggaggatacaggcacctgtcagggcctgccagacagtgagtcctctttcacatatacactagatgaaaaggtggccgagttagtggagttcctgctcctcaaatacgaagcagaggagcctgtaacagaggcagagatgctgatgattgtcatcaagtacaaagattactttcctgtgatactcaagagagcccgtgagttcatggagcttctttttggccttgccctgatagaagtgggccctgaccacttctgtgtgtttgcaaacacagtaggcctcaccgatgagggtagtgatgatgagggcatgcccgagaacagcctcctgattattattctgagtgtgatcttcataaagggcaactgtgcctctgaggaggtcatctgggaagtgctgaatgcagtaggggtatatgctgggagggagcacttcgtctatggggagcctagggagctcctcactaaagtttgggtgcagggacattacctggagtatcgggaggtgccccacagttctcctccatattatgaattcctgtggggtccaagagcccattcagaaagcatcaagaagaaagtactagagtttttagccaagctgaacaacactgttcctagttcctttccatcctggtacaaggatgctttgaaagatgtggaagagagagtccaggccacaattgataccgcagatgatgccactgtcatggccagtgaaagcctcagtgtcatgtccagcaacgtctccttttctgagtgaagtctaggatagtttcttccccttgtgtttgaacagggcagtttaggttctaggtagtggagggccaggtggggctcgaggaacgtagtgttctttgcatttctgtcccatatgggtgatgtagagatttacctgtttttcagtattttctaaatgcttttcctttgaatagcaggtagttagcttcagagtgttaatttatgaatattagtcgcacatgtattgctctttatctggtttaagagtaacagtttgatattttgttaaaaaaatggaaataccttctcccttattttgtgatctgtaacagggtagtgtggtattgtaataggcatttttttttttttttacaatgtgcaataactcagcagttaaatagtggaacaaaattgaagggtggtcagtagtttcatttccttgtcctgcttattcttttgttcttgaaaattatatatacctggctttgcttagcttgttgaagaaagtagcagaaattaaatcttaataaaagaaagccccactgactcctt

SEQ ID NO: 378136 - DNA, 1753 bp, Homo sapiens
agcgggctttcccgacggccatcttgggaatctgacggatcggaggcatttgtgaggaggcgcgaatcaagttagcggggggaagagtcttagacctggccagtcctcagggtgagggccctgaggaagaactgagggacctcccaccatagagagaagaaaccccggcctgtactgcgctgccgtgagactggtgctccaggaaccaggtggtgacgaactgggtgtgaggcacacagcctaaagtcagcacagcagaggaggcccaggcagtgccaggagtcaaggcctgttggatctcatcatccatatccctgttgatacgtttacctgctgctcctgaagaagtcgtcatgcctcccgttccaggcgttccattccgcaacgttgacaacgactccccgacctcagttgagttagaagactgggtagatgcacagcatcccacagatgaggaagaaggggaggatacaggcacctgtcagggcctgccagacagtgagtcctctttcacatatacactagatgaaaaggtggccgagttagtggagttcctgctcctcaaatacgaagcagaggagcctgtaacagaggcagagatgctgatgattgtcatcaagtacaaagattactttcctgtgatactcaagagagcccgtgagttcatggagcttctttttggccttgccctgatagaagtgggccctgaccacttctgtgtgtttgcaaacacagtaggcctcaccgatgagggtagtgatgatgagggcatgcccgagaacagcctcctgattattattctgagtgtgatcttcataaagggcaactgtgcctctgaggaggtcatctgggaagtgctgaatgcagtaggggtatatgctgggagggagcacttcgtctatggggagcctagggagctcctcactaaagtttgggtgcagggacattacctggagtatcgggaggtgccccacagttctcctccatattatgaattcctgtggggtccaagagcccattcagaaagcatcaagaagaaagtactagagtttttagccaagctgaacaacactgttcctagttcctttccatcctggtacaaggatgctttgaaagatgtggaagagagagtccaggccacaattgataccgcagatgatgccactgtcatggccagtgaaagcctcagtgtcatgtccagcaacgtctccttttctgagtgaagtctaggatagtttcttccccttgtgtttgaacagggcagtttaggttctaggtagtggagggccaggtggggctcgaggaacgtagtgttctttgcatttctgtcccatatgggtgatgtagagatttacctgtttttcagtattttctaaatgcttttcctttgaatagcaggtagttagcttcagagtgttaatttatgaatattagtcgcacatgtattgctctttatctggtttaagagtaacagtttgatattttgttaaaaaaatggaaataccttctcccttattttgtgatctgtaacagggtagtgtggtattgtaataggcatttttttttttttttacaatgtgcaataactcagcagttaaatagtggaacaaaattgaagggtggtcagtagtttcatttccttgtcctgcttattcttttgttcttgaaaattatatatacctggctttgcttagcttgttgaagaaagtagcagaaattaaatcttaataaaagaaagccccactgactcctt

SEQ ID NO: 378137 - DNA, 2005 bp, Homo sapiens
agcgggctttcccgacggccatcttgggaatctgacggatcggaggcatttgtgaggaggcgcgaatcaagttagcggggggaagagtcttagacctggccagtcctcagggtgagggccctgaggaagaactgagggacctcccaccatagagagaagaaaccccggcctgtactgcgctgccgtgagactggtgctccaggaaccaggtggtgacgaactgggtgtgaggcacacagcctaaagtcagcacagcagaggaggcccaggcagtgccaggagtcaaggcctgttggatctcatcatccatatccctgttgatacgtttacctgctgctcctgaagaagtcgtcatgcctcccgttccaggcgttccattccgcaacgttgacaacgactccccgacctcagttgagttagaagactgggtagatgcacagcatcccacagatgaggaagaggaggaagcctcctccgcctcttccactttgtacttagtattttccccctcttctttctccacatcctcttctctgattcttggtggtcctgaggaggaggaggtgccctctggtgtgataccaaatcttaccgagagcattcccagtagtcctccacagggtcctccacagggtccttcccagagtcctctgagctcctgctgctcctctttttcatggagctcattcagtgaggagtccagcagccagaaaggggaggatacaggcacctgtcagggcctgccagacagtgagtcctctttcacatatacactagatgaaaaggtggccgagttagtggagttcctgctcctcaaatacgaagcagaggagcctgtaacagaggcagagatgctgatgattgtcatcaagtacaaagattactttcctgtgatactcaagagagcccgtgagttcatggagcttctttttggccttgccctgatagaagtgggccctgaccacttctgtgtgtttgcaaacacagtaggcctcaccgatgagggtagtgatgatgagggcatgcccgagaacagcctcctgattattattctgagtgtgatcttcataaagggcaactgtgcctctgaggaggtcatctgggaagtgctgaatgcagtaggggtatatgctgggagggagcacttcgtctatggggagcctagggagctcctcactaaagtttgggtgcagggacattacctggagtatcgggaggtgccccacagttctcctccatattatgaattcctgtggggtccaagagcccattcagaaagcatcaagaagaaagtactagagtttttagccaagctgaacaacactgttcctagttcctttccatcctggtacaaggatgctttgaaagatgtggaagagagagtccaggccacaattgataccgcagatgatgccactgtcatggccagtgaaagcctcagtgtcatgtccagcaacgtctccttttctgagtgaagtctaggatagtttcttccccttgtgtttgaacagggcagtttaggttctaggtagtggagggccaggtggggctcgaggaacgtagtgttctttgcatttctgtcccatatgggtgatgtagagatttacctgtttttcagtattttctaaatgcttttcctttgaatagcaggtagttagcttcagagtgttaatttatgaatattagtcgcacatgtattgctctttatctggtttaagagtaacagtttgatattttgttaaaaaaatggaaataccttctcccttattttgtgatctgtaacagggtagtgtggtattgtaataggcatttttttttttttttacaatgtgcaataactcagcagttaaatagtggaacaaaattgaagggtggtcagtagtttcatttccttgtcctgcttattcttttgttcttgaaaattatatatacctggctttgcttagcttgttgaagaaagtagcagaaattaaatcttaataaaagaaagccccactgactcctt

SEQ ID NO: 378138 - DNA, 2050 bp, Homo sapiens
agcgggctttcccgacggccatcttgggaatctgacggatcggaggcatttgtgaggaggcgcgaatcaagttagcggggggaagagtcttagacctggccagtcctcagggtgagggccctgaggaagaactgagggacctcccaccatagagagaagaaaccccggcctgtactgcgctgccgtgagactggtgctccaggaaccaggtggtgacgaactgggcgtgtgcacggcacacaaggcctataaagaggctcaaggccaaccaaggcaggaaggggaaggggcccccaagggcgcaaggttgccccaagcccctgttcaaaggggcctgttggatctcatcatccatatccctgttgatacgtttacctgctgctcctgaagaagtcgtcatgcctcccgttccaggcgttccattccgcaacgttgacaacgactccccgacctcagttgagttagaagactgggtagatgcacagcatcccacagatgaggaagaggaggaagcctcctccgcctcttccactttgtacttagtattttccccctcttctttctccacatcctcttctctgattcttggtggtcctgaggaggaggaggtgccctctggtgtgataccaaatcttaccgagagcattcccagtagtcctccacagggtcctccacagggtccttcccagagtcctctgagctcctgctgctcctctttttcatggagctcattcagtgaggagtccagcagccagaaaggggaggatacaggcacctgtcagggcctgccagacagtgagtcctctttcacatatacactagatgaaaaggtggccgagttagtggagttcctgctcctcaaatacgaagcagaggagcctgtaacagaggcagagatgctgatgattgtcatcaagtacaaagattactttcctgtgatactcaagagagcccgtgagttcatggagcttctttttggccttgccctgatagaagtgggccctgaccacttctgtgtgtttgcaaacacagtaggcctcaccgatgagggtagtgatgatgagggcatgcccgagaacagcctcctgattattattctgagtgtgatcttcataaagggcaactgtgcctctgaggaggtcatctgggaagtgctgaatgcagtaggggtatatgctgggagggagcacttcgtctatggggagcctagggagctcctcactaaagtttgggtgcagggacattacctggagtatcgggaggtgccccacagttctcctccatattatgaattcctgtggggtccaagagcccattcagaaagcatcaagaagaaagtactagagtttttagccaagctgaacaacactgttcctagttcctttccatcctggtacaaggatgctttgaaagatgtggaagagagagtccaggccacaattgataccgcagatgatgccactgtcatggccagtgaaagcctcagtgtcatgtccagcaacgtctccttttctgagtgaagtctaggatagtttcttccccttgtgtttgaacagggcagtttaggttctaggtagtggagggccaggtggggctcgaggaacgtagtgttctttgcatttctgtcccatatgggtgatgtagagatttacctgtttttcagtattttctaaatgcttttcctttgaatagcaggtagttagcttcagagtgttaatttatgaatattagtcgcacatgtattgctctttatctggtttaagagtaacagtttgatattttgttaaaaaaatggaaataccttctcccttattttgtgatctgtaacagggtagtgtggtattgtaataggcatttttttttttttttacaatgtgcaataactcagcagttaaatagtggaacaaaattgaagggtggtcagtagtttcatttccttgtcctgcttattcttttgttcttgaaaattatatatacctggctttgcttagcttgttgaagaaagtagcagaaattaaatcttaataaaagaaagccccactgactcctt

SEQ ID NO: 378139 - DNA, 388 bp, Homo sapiens
tcacattatttccgaagtattctcccattcccagtcccacctctacagctcttttaaataatcgttacatataatgctattttgtttgtctcttagccgttataaactctaattttattctgaagtacaactcaggacgctgtgcaaaaccttggtagtgttttctttaatattttaaagcctaataggactcactactcatttgacacatcattatttatcacttgtgttgaaactttttgattttacacgttcttttcttccaaaatatatcataaatgctctgagggcacacatattattttatttctctttagagtgctcttgccatgcatgcagccttataaacatattaagtatttttaaattatagggatagtgcatgctc

SEQ ID NO: 378140 - DNA, 279 bp, Homo sapiens
tctcctacagctcctgttcagggacgggagggcagccaggcaagaaaccaaacacgaggtcaggcctgagcagagtccttgaatggaaggcccccaaagtggcaattttagggtttcctgtctattcccatgggtctggccgccaagggaactggcaggttggaagaacttgccactgggggcagctcctgccagggtggcaagcacgggcgagcacaggggtgggacagcctcctggactgggtcaccttgtctccaacactgctccctgatactggc

SEQ ID NO: 378141 - DNA, 369 bp, Homo sapiens
gactggcctcctaaagtctttgcaaatttaaatgaggtaatacacgcaaacattttgcatagcatttggcccatagttagagtgaatatactggctgttagtaattagcaagttcctgttgttgatcactcaaggcatggcagtgtgctgtgcagctcagtttctgcacatgcctacactggcttttgcattctctggatgaggcagagtggtttttcaaggttgcttacaagaaagtataaaaacccaagagctaatgcatgctgggattaatacctaggtgatgggttgataagtgcagcaaaccaccatggcacacgtttacctatgtaacaaacctgcacatcctacacatgtaccctggtactt

SEQ ID NO: 378142 - DNA, 1769 bp, Homo sapiens
ttgtgatggaagatttctttccatagattagtataatttacgtgggctgtttgaagagattaccttcttagtggttcccttaaagctctttgttatgtatatcctgaagcccagtcacttcttcccacttgtttttgagtgtttgatctagacaatgtaaaggcacttttaagataaaaattattgtatttgggggactttgggagactcacttcccaatcattttgtttagaagcaaaaatgattaaacagtactttatgtcagatctgcctgtttaagggatttgagcacacctggtagcaaagaggtttaacctagtttctcagatgaaaactagaggtggaggaaggacgaggaagcagtccagggtgagctgaggagctggttacctttagcctacttctgggatgatgcacattgtcgtctaggtcagtcagcctcctcagcccatgcattaagattcctggttgcagctgggcacagtggctcacacctgtaatctcagcactttgggaagctgaggtgggcaggtaacctgagttcaggagttcaagactggcctggccaacatggtgaaacctcatctctactagaaatacaaaaattagccagatgtggtggcggacgcctgtaatcccagctacttgggaggctgaggcaggagaatcactcgaacctgggtgttggaggttgcagtgagccaggattgtgccactgcattacagcctgggtgacaaagtgagattctgtctcaaaaaaaaaaaaaaaaaaaaaaaattcctggttgttagtaacagaaactcacatagtctagctgaagcaaaaggggtttttttttttgcttacttaactagatttcaggaagagctggaatgaggtgggttttaaggacattcataaccagggacttgaaacacagctgtgtgccctatgtggctccgtgctctcctcaccttttatctcttagtgttgcgttaatttttgtcttgctgctggtgggcttcctctacatggaaggggatatgactgtggtcattgcccatctatagacatctttattgctgtgatctgagagaaaacaggcttcttttcccccagcttaagtttgacaaatcccagggaagaatggtcactggcctagcctaggtcatgtgtttgtgacagttctaaggggtgcgtgataggctcagcttgtgtcacatgcccagggaggtcacacagatgataccctgagggaactgctgtaaacagttaagatacagcagttttcatgcatttttagtccatatggaactcagctcaaacaactagttaagattctttccttgattcattgaaaatcttttacagtctttgttgatgctggtgcctgtaatcccggctactcaagaggctgaggcgggaggatcgaatattcgcagtggcctgtgaatagacacttcactccagcctaggcaacatagtgagaccctgtctcaaaaaaaatagaatgaggctgggcacagtggctcacacctgtaatcccagcactttgggaggcaaaggcaggcagatcgcctgaggtcaggagtttgagaccagcctgggcaacatggtgaacaccctgtctctactaaaaataccaaaattagctgggtgtggtggcagtgcctgtaatcccagctactcgggaggctgaggcagaattactttgagcccgggaggtggaggctgcagcgagctgagatcgcgccactgcgctccagcctgggcagagtgagactctatc

SEQ ID NO: 378143 - DNA, 549 bp, Homo sapiens
ttgtgatggaagatttctttccatagattagtataatttacgtgggctgtttgaagagattaccttcttagtggttcccttaaagctctttgttatgtatatcctgaagcccagtcacttcttcccacttgtttttgagtgtttgatctagacaatgtaaaggcacttttaagataaaaattattgtatttgggggactttgggagactcacttcccaatcattttgtttagaagcaaaaatgattaaacagtactttatgtcagatctgcctgtttaagggatttgagcacacctggtagcaaagaggtttaacctagtttctcagatgaaaactagaggtggaggaaggacgaggaagcagtccagggtgagctgaggagctggttacctttagcctacttctgggatgatgcacattgtcgtctaggtcagtcagcctcctcagcccatgcattaagattcctggtcttgaactcctaggctcaagcgatcagcccacctcggcctcccaaagtgttgggattacaggtataagccactgtacctg

SEQ ID NO: 378144 - DNA, 340 bp, Homo sapiens
gacatacacatatacacatacacaagtacacatgtatacacatgcatacacacatgcacacaggcatatacacatgtacacacacattaacacatgtactcacacgtcatacacatacacagagaccctgacacgcgtataaacatgcactcacacatgaactcatgcaaatacagatgcagtcatacatggatatacgcacacgccatctcacccacacgcgcgcacacgtgccctcacccacacacatacgccctcacccacacacatgcgcacacaagcacccttacctacacacatgcgcacacatctctcacccacacacacgcacacacaggcc

SEQ ID NO: 378145 - DNA, 1924 bp, Homo sapiens
  misc_feature (1021)..(1021): n is a, c, g, or t
  misc_feature (1023)..(1023): n is a, c, g, or t
  misc_feature (1038)..(1039): n is a, c, g, or t
agtgcctttatatacttcctatcctgagactactttactggggtaattcaatctctaaacactccctgaattaagaatcaagggacctatatgaagaaagacaagtctttcctctggagttaaggagacctacctccttcaaaagaagggagaaaaaaaagtctcctcccatctctctctaaactacggtaagtatattcatttctgtaacttctataacaccacaaacgtaaaacaacaggaatttatcttacagttctgaaggtcagtagtccaaaatcagtttcactgagctaaaaacaaagtgtgtgcagacgtgtgttccttctggaggctctacagaatatgtttccttgccttttccagcttctaaaggttagctgcacacctgggcttatgggatgttccatcatcttcaaaaccagcagtgcagcatcttctctcttgacctttgcttttggtcttaacccttctctgactaattcctcctgcctccctcttattaggaacctttgtgatcacactgggccaatccagttatccaggacagcctccccattgcaagatccttaatcaaatttgcaaaatccaatttaccatctaacgcaacatatgcacaggttttagggattaaaacatgagtatctttggaggggtacattattcagcctaccattgcaaatatccacaataatctgtaaaacagatgataacaacaaaaaactaatttcttaaattccctcacttttcatttattagggggtaagaaagatcccactgttttactcattctctcaaattacttttaaaaacctctattttcttccagtttccttgctggttttgtttttactcttagtcctttatccatctagaagttatttttgtgaatgatttaagataggggctttaaatatttttccagactgacaatcaaatatcctattaccatgtattgatatttgccctactaatataaatgtcattcacaatataattctttatatgtaggtatgttctngnttctctttctttttnnttttttttttttttttttaagacagagtcttgcactgttgcccaggctggagtgcagtggtgtgatctcggctcactgcaacctctgcctcccgggttcaagcgattctcctgcctcagcctcccaagtagctgggactacaggcacatgccaccacgcccagctcatttttgtatttttagtagagatggggtttcacaatgttggccaggatggtctcgatctcttgacctcatgatccacctgcctcagcctcccaaagtgctgggatcacaggggtgagccaccggcacccggcctttttttaaaaaaaaaaaaatagagacagggtctatgttgcccaaactgatctcacacttctggcctcaagtgatgctccccacctcagcctcccaaagtgctgggattacaggtgtaagccaccacacctagcctgtttctgggttctctaattttatctatttgttcttttgctaataattgcaaaattttaactatagtagtttctaaattttaatagctggtgggataagtctcgtttttttaaactgtccttgttatagttacataccaaacaaactttataggcttctcaaattcatacaaaaattcctttgggattttggttaaagtttcactgaatttataaatcaattagggggaaaagtgacatctttatcgggctatcctacccataaacaccctatgggccaaaactatggccaaggctattatggcctactgtctctctctctcagaatatcatccgacatcttgaatacttacaatgttagagacatgctgattgagatgtgggcaaagaccaaattaagtaagaaggggacttgaacactacctccaaagaatatgaattctatccaactg

SEQ ID NO: 378146 - DNA, 521 bp, Homo sapiens
agacagtatgtgtccattaccgggtcagacacagttttggggagcaattaggtctttgaggtcagtgaatgtaagcaatctgaaatgcagctggggccggggcagtggcttatgcctgtaatcccaacacttcgggaggccgaggcaggtggatcacttgaggtcaggagttcgagaccagactggccaacatgggtgaaacctcatctctactaaaaataaaaaaattagacaggtgcagtggtaccacactgagtagtcccagctactcgggaggctgaggcatgaaaatcacttcagcctgggaggtgaaggttgcagtgagctgagatcacgccactacactccagcctaggtgacagagcaagactctgtctcaaacaaataaaataaaatgcagctgggctgggcatggtcgctcacgcctgtaatcccagcactttgggaggctgaggtgggagtatcccttgagtccaggatttcaagaccagcctgggcaatatagtgagaccctgtctcta

SEQ ID NO: 378147 - DNA, 639 bp, Homo sapiens
gaatcagccttaggttctctgcctccagatcctattctcctgcctcaccaccaccccaaaaagctccctcagtcacaaaagatgacctcacttccaacctcacagagaaatttgaagctgccagagaggagccctcaactttccagcacctactttcaaacctacaacctatctgtatcttctctcctctcctcaattcctgtgaaagccaactcccttcttcctagtttcggtccaatctctctgtctgtgttctgtagcccacttcgagaatcatctcctatcaataatctcttctctcttctgtgtcttctaactcaccatctttgcttggttcccccatggtcattcaaacatacttaattcatacaaaaaaaattagaatgaataagacctactatttgatagcacaagatgactataatcaataccttaactgtacattttttaataactaaaagagtataattggattgtttgtaacacaagggataaatgcttcagggaagggataccccattctacatgatgtgattacacactacatgcctgtatcaaaacatcgcatgtaccccataaagctatacacctactatgtacccgcaagaattaaaaataaaaaaaacttaaatttaaatt

SEQ ID NO: 378148 - DNA, 1843 bp, Homo sapiens
cccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccgcgtgggccgcttctcgtgggcctggtggggtgtccacttctggctgcgcctcctggagctgacatgggcgctcgccctggcgttggccgcggtggctgccgcgagacccaggccgcccacggagcacgcttgctgggctaagctgatgcgtctggcgtgcccggcgccgtcaggaaagagcgaggtgccggagcgacccaataactgctatgcagggcccagcaacgttggtgcaggcagcttggacatcagcaagagcctcatccgcaacccggcggagagtgggcagctggccacgcccagttcaggcgcctggggctcggctgcgtcgttgggtcgcggaccccagggtggcccgggactgtcccgcaacggtgtgggaccggcgccatcgctgagcgagctggatctgcggccgccatcgcccatcaacctgagccgcagcatcgacgccgcgctcttccgcgagcacctagtgcgagacagtgtgttccagcgctgcggcctccgcggcctggcctccccgccgcctggaggcgctctgcggccgcgccggggcagccatcccaaagccgagctcgacgacgctggctcctcgctcctccgcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgaggtgggtggaacacgaggtcaggagttcgagatcagcctcctggtctcgaacatagcgaaaccctcgtctctactaaaaatacaaaaaaattagccaggtgg

SEQ ID NO: 378149 - DNA, 2283 bp, Homo sapiens
cccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccgcgtgggccgcttctcgtgggcctggtggggtgtccacttctggctgcgcctcctggagctgacatgggcgctcgccctggcgttggccgcggtggctgccgcgagacccaggccgcccacggagcacgcttgctgggctaagctgatgcgtctggcgtgcccggcgccgtcaggaaagagcgaggtgccggagcgacccaataactgctatgcagggcccagcaacgttggtgcaggcagcttggacatcagcaagagcctcatccgcaacccggcggagagtgggcagctggccacgcccagttcaggcgcctggggctcggctgcgtcgttgggtcgcggaccccagggtggcccgggactgtcccgcaacggtgtgggaccggcgccatcgctgagcgagctggatctgcggccgccatcgcccatcaacctgagccgcagcatcgacgccgcgctcttccgcgagcacctagtgcgagacagtgtgttccagcgctgcggcctccgcggcctggcctccccgccgcctggaggcgctctgcggccgcgccggggcagccatcccaaagccgagctcgacgacgctggctcctcgctcctccgcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgaggtgggtggaacacgaggtcaggagttcgagatcagcctcctggtctcgaacatagcgaaaccctcgtctctactaaaaatacaaaaaaattagccaggtggcacacgcctgtagtcccagctactcgggaggctgaggcgggagaattgcttgaacagggaggcagaggttgcagtgagccgagaccacgccattgcactccagcctgggtgacaagagtgagactccgtctcaaaaaaaaaaaaaaaaaaaaaaaaaaaaggcatccccaggcctctctacctgacggcaacccccgggggacagccaggtttgaactcaccccacccccatgccgttttttgcttttaatatttctatttttttttcagccggcattttgcacagaggccgtgtcttatgcggaatacagggtgggtgtgcatggattcgggcatgaagaacagggagcaggtgccccagactccccaacgtggagtgatgagcctcgcttgtctagattgtcctctttgtgccaaagaaataaacccttaggacttgg

SEQ ID NO: 378150 - DNA, 471 bp, Homo sapiens
gtgatccacccacctcggcctcccaaagtgctgggattacaggtgtgagccgcccggctggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgaggtgggtggaacacgaggtcaggagttcgagatcagcctcctggtctcgaacatagcgaaaccctcgtctctactaaaaatacaaaaaaattagccaggtgg

SEQ ID NO: 378151 - DNA, 1912 bp, Homo sapiens
cccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccgcgtgggccgcttctcgtgggcctggtggggtgtccacttctggctgcgcctcctggagctgacatgggcgctcgccctggcgttggccgcggtggctgccgcgagacccaggccgcccacggagcacgcttgctgggctaagctgatgcgtctggcgtgcccggcgccgtcaggaaagagcgaggtgccggagcgacccaataactgctatgcagggcccagcaacgttggtgcaggcagcttggacatcagcaagagcctcatccgcaacccggcggagagtgggcagctggccacgcccagttcaggcgcctggggctcggctgcgtcgttgggtcgcggaccccagggtggcccgggactgtcccgcaacggtgtgggaccggcgccatcgctgagcgagctggatctgcggccgccatcgcccatcaacctgagccgcagcatcgacgccgcgctcttccgcgagcacctagtgcgagacagtgtgttccagcgctgcggcctccgcggcctggcctccccgccgcctggaggcgctctgcggccgcgccggggcagccatcccaaagccgagctcgacgacgctggctcctcgctcctccgcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgagccggcattttgcacagaggccgtgtcttatgcggaatacagggtgggtgtgcatggattcgggcatgaagaacagggagcaggtgccccagactccccaacgtggagtgatgagcctcgcttgtctagattgtcctctttgtgccaaagaaataaacccttaggacttgg

SEQ ID NO: 378152 - DNA, 608 bp, Homo sapiens
  misc_feature (601)..(601): n is a, c, g, or t
ttttttttccacttccccaatccctcagctctaaatttatctggaaatattttgagtttttcttacagtggagaactatttgacttagggctacacaacaatgcttgccacctccgtattttgaagatcttcctctgtgaatccttcccacattcaaggaggtacgcaggaaaagcctgtggcaggcagtagcccttgatctaggctgctcagggccacgtagatcatctgaagattgtcacctaaatacagctgttactaaacctttgccaagggaaagcagagaagggacaagtcattgccatccctcagcagcagcttcaaggtcattcgtaagtgagagcccggaagttatgcaacactttctctctaggtcctccagacaatgatttttacaacagccagatggtaaattcacgtttgtggctattccactgccttgtcctatcagcatcaggcatgatggccatgggcctttcacgactggtgtggacacacatagctctacactgatggcacccaagtcacagcagggactcgtgtggcagtttgcatttcttatgataatctttttgttcacccaagtttttaagagctaaangagacag

SEQ ID NO: 378153 - DNA, 817 bp, Homo sapiens
gccctgtccaattattagaaaaaaaaaggaacatgacttagtacattcattttggaggataagtctctcaaaataggcctttcactgggggaaaatggtaaaaatactccctggtaattcaagaattggagactcctgagatgctgctcatattagctgagcacttatcaatacttcacttttttccatatatactcaaggaacaagtgctatttaaagtgtttcactccactgggctaggtgcaagactataaagaggtgtgaggatcaacacttttatgaaaaccagtgtcattctggatatagtttcagatgctagtgcaaaggaagctcttggtatacggaaaaagtattcaacaataaattaggcatggttgcttccattttctgcctcacatacttttttttcgtggttaaagtgatataatgtctatgatattttagattggcagttgcaaactagtggtcctcagcgtgctttttatgacacctacaaggtctgaagactttgatttcatattaaaaatctgggtttcaggctgggtgtggtgttgcatgcctgtaatcccagcactttgggaggctgaggcaagagaatcgcttgaaccagggaggtggaggttgcagtgagccaagatcgcgccactgcactcaagcttaggcaatagagcaagactccatctcaaaaaatgaataaataaataaataaaatctgggtttcaggccaggtgtggtggtgcactcctgcaatcccagcactttgggaggctgagatgggcagacagcttgacctcaggaattccagactagcctgggc

SEQ ID NO: 378154 - DNA, 326 bp, Homo sapiens
ccagggcagggaggtggaatgtatccagggaaaaaggcctgtccacctggctcttcacatgtataacacatcccagagctacaggacttagcagaaattgagctgggggaaactgggttggaagaagggatgagttcaacttgactaaaagtggtgtctcaagtaggcagcataggcagcaccaagcttctacataaagaggtacagataacaatgctagaggtgagaacaaaatagtcaatccagtgaaaactgaattataaaccagctagatatctcagaatagtacagtagagaatcaggatatggcatctctgaaactttgc

SEQ ID NO: 378155 - DNA, 416 bp, Homo sapiens
tcacacctgtattcctagcactttgggaggctgagatgggagtatcacttgaggccagtgatgcaagaccagcctgggcaacatagggagacactatctctacaaaaaataaaaaattagccaggtatggtggtgtatgcctccactcccagctactcaggagacggaggcaggaggatcacctcagcccaggagtttaaggctgcagtaagccattggagctccagcctaggtggcagagtgagaacctgtctgaggaaaaacaaaaaaaaagtaacttgcagaattatatatatagtgtgattgttatgggaaaatatgcataacataaaatttaccattttaaagtttgcaattcagtaggactaataagtacattcttaatgtgcagtcatcaccactgtctattctgtagc

SEQ ID NO: 378156 - DNA, 796 bp, Homo sapiens
tgaagtggcatgatctcagctcactggaatgtccacctcctaggttcaagtgattctcctgcctcagcctcccaagtggctgggattacaggatttttcatgggccgatctgctgaattcagcctaggagctgagaccaacatctgagtctcttcagcacacaagtttgaaagaagtcctagcaacttcaagctcagaactacgggtggcagcagctccctcttgacgtcgaagcctcccattccagagagagtcaaggcctggatcaaacaaagcccacaagcaccgatgactgagctgctgactacccccagcatctccaactcaacctcctctttctgcctctacccaaattttaaaactttcaaacatgggtttaaaaatggtaatgagtaaagttgcatccaagtgtatcaaataaaactaaatatccataaaaactgtaataattcctgctttgatgctgaactaaagaattttctgccaggcgtggtggctaacacctgtaatcccagcactttgggaggccaaggcaggtggatcacgaggtcaggagttcaagacctgcctggccaacgtggtgaaaccccatctctactaaaaatacaaaaattagctgggcatggtggcaggcatctgtagtcccagctactcaggaggctgaggcaggagaatcacttgaacccgggagacagaggttgtagtgagccaagatggcaccactgcactccatcctgggcaacaagcgagattccatctcaaaagaaaaaaaaaaaagaattttctgtttatatta

SEQ ID NO: 378157 - DNA, 809 bp, Homo sapiens
cttttcagattgcaggatttccactacctgtcctcttccttggtgtcaagcccaggacaataggtgttgctttctgacagatcctttgctttgtctcaatataggatttttcatgggccgatctgctgaattcagcctaggagctgagaccaacatctgagtctcttcagcacacaagtttgaaagaagtcctagcaacttcaagctcagaactacgggtggcagcagctccctcttgacgtcgaagcctcccattccagagagagtcaaggcctggatcaaacaaagcccacaagcaccgatgactgagctgctgactacccccagcatctccaactcaacctcctctttctgcctctacccaaattttaaaactttcaaacatgggtttaaaaatggtaatgagtaaagttgcatccaagtgtatcaaataaaactaaatatccataaaaactgtaataattcctgctttgatgctgaactaaagaattttctgccaggcgtggtggctaacacctgtaatcccagcactttgggaggccaaggcaggtggatcacgaggtcaggagttcaagacctgcctggccaacgtggtgaaaccccatctctactaaaaatacaaaaattagctgggcatggtggcaggcatctgtagtcccagctactcaggaggctgaggcaggagaatcacttgaacccgggagacagaggttgtagtgagccaagatggcaccactgcactccatcctgggcaacaagcgagattccatctcaaaagaaaaaaaaaaaagaattttctgtttatatta

SEQ ID NO: 378158 - DNA, 747 bp, Homo sapiens
gcgtgacgtggaggaaccgcaggcggcgaccgcggacagaatgatttttcatgggccgatctgctgaattcagcctaggagctgagaccaacatctgagtctcttcagcacacaagtttgaaagaagtcctagcaacttcaagctcagaactacgggtggcagcagctccctcttgacgtcgaagcctcccattccagagagagtcaaggcctggatcaaacaaagcccacaagcaccgatgactgagctgctgactacccccagcatctccaactcaacctcctctttctgcctctacccaaattttaaaactttcaaacatgggtttaaaaatggtaatgagtaaagttgcatccaagtgtatcaaataaaactaaatatccataaaaactgtaataattcctgctttgatgctgaactaaagaattttctgccaggcgtggtggctaacacctgtaatcccagcactttgggaggccaaggcaggtggatcacgaggtcaggagttcaagacctgcctggccaacgtggtgaaaccccatctctactaaaaatacaaaaattagctgggcatggtggcaggcatctgtagtcccagctactcaggaggctgaggcaggagaatcacttgaacccgggagacagaggttgtagtgagccaagatggcaccactgcactccatcctgggcaacaagcgagattccatctcaaaagaaaaaaaaaaaagaattttctgtttatatta

SEQ ID NO: 378159 - DNA, 763 bp, Homo sapiens
ctaggtaatttatatctcatgttacacctgagcaaacaaccaacccacacactttcaggatttttcatgggccgatctgctgaattcagcctaggagctgagaccaacatctgagtctcttcagcacacaagtttgaaagaagtcctagcaacttcaagctcagaactacgggtggcagcagctccctcttgacgtcgaagcctcccattccagagagagtcaaggcctggatcaaacaaagcccacaagcaccgatgactgagctgctgactacccccagcatctccaactcaacctcctctttctgcctctacccaaattttaaaactttcaaacatgggtttaaaaatggtaatgagtaaagttgcatccaagtgtatcaaataaaactaaatatccataaaaactgtaataattcctgctttgatgctgaactaaagaattttctgccaggcgtggtggctaacacctgtaatcccagcactttgggaggccaaggcaggtggatcacgaggtcaggagttcaagacctgcctggccaacgtggtgaaaccccatctctactaaaaatacaaaaattagctgggcatggtggcaggcatctgtagtcccagctactcaggaggctgaggcaggagaatcacttgaacccgggagacagaggttgtagtgagccaagatggcaccactgcactccatcctgggcaacaagcgagattccatctcaaaagaaaaaaaaaaaagaattttctgtttatatta

SEQ ID NO: 378160 - DNA, 887 bp, Homo sapiens
ctccaatctaactaccctacacctgcggcaatctagctgaactaaacttcacctagtgaggaatgcctgtgcctgcttcccctttgccttctgccatgactgaaagtttcctaaggcctcctcagaagccgagcagatgccagcatcatgcttcctctaaagcctgtggaaccatgagccaagatttttcatgggccgatctgctgaattcagcctaggagctgagaccaacatctgagtctcttcagcacacaagtttgaaagaagtcctagcaacttcaagctcagaactacgggtggcagcagctccctcttgacgtcgaagcctcccattccagagagagtcaaggcctggatcaaacaaagcccacaagcaccgatgactgagctgctgactacccccagcatctccaactcaacctcctctttctgcctctacccaaattttaaaactttcaaacatgggtttaaaaatggtaatgagtaaagttgcatccaagtgtatcaaataaaactaaatatccataaaaactgtaataattcctgctttgatgctgaactaaagaattttctgccaggcgtggtggctaacacctgtaatcccagcactttgggaggccaaggcaggtggatcacgaggtcaggagttcaagacctgcctggccaacgtggtgaaaccccatctctactaaaaatacaaaaattagctgggcatggtggcaggcatctgtagtcccagctactcaggaggctgaggcaggagaatcacttgaacccgggagacagaggttgtagtgagccaagatggcaccactgcactccatcctgggcaacaagcgagattccatctcaaaagaaaaaaaaaaaagaattttctgtttatatta

SEQ ID NO: 378161 - DNA, 428 bp, Homo sapiens
gtcaatggatgaatgaataaagtaaatgtggtatatgtacacaatggaatactattcatctctaaaaaataaaattctgtcatctgtgacaacaaggatgaacctggaagacattatgttaaataagccccacccagccccccagtgcccgtcttcctgtcccatctgctcagagagagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378162 - DNA, 976 bp, Homo sapiens
aaagctacaatatctttctcccccaagggaaatgatgtgcccagcatagtcaagacagacaagagggagctcccatggctgagttggggcctcaagccctccctctactcctcctcagagaccaggggtgacagagacagatcttgaaaaccttgggacaagtgcccttgggctgcagggttgggaacggggggagcatggccagcctatcacctggtgtgccctcaggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378163 - DNA, 323 bp, Homo sapiens
catctggcagcatttccggctcaaggcttcctgtgcagcccgattgttctggtgtccaaagagtgttcccccataggagttctatagcacatgcaaccccttaaccaagctgttttggaatgtgctatgctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378164 - DNA, 1684 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378165 - DNA, 1807 bp, Homo sapiens
ctgctccgcccctctctgaggatgatgctgtttcctccaggtcccgggccatcacgattggcatttcctttagggtttgtcatgcagtcagcagacggcggcctcagagacctttcctagcagattcactggatcaagcaatttggatggcacagattcctgtctcatcttcccatggttcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378166 - DNA, 1340 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378167 - DNA, 1630 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378168 - DNA, 1630 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccgggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378169 - DNA, 1639 bp, Homo sapiens
cgggaactagtatcagcgggtgatcgccgaggcggccggcgcggtgatctccaagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378170 - DNA, 1655 bp, Homo sapiens
aaaaaaaaaaaaaaaaaaaaaaaaaaaaaaaaaaaaaaaaaaaaaaaaaaaaaaaaaaaaaaaaaggagagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378171 - DNA, 1052 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgtttgaggttttcttggttggaagctgcagctggcccaagaaagaaaataaaaaacaacacttttg

SEQ ID NO: 378172 - DNA, 1503 bp, Homo sapiens
tgtggttcttgtgctggtggttcttgtgctggaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378173 - DNA, 1604 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378174 - DNA, 2024 bp, Homo sapiens
cctttcccaaatttaaaatcttgcaagagatagtacaacaaaggtagcccagttcttcctcagtgccatcctggtgtgttcaggttttttggcaaaacctttgaggagctggtgggtggcaggactaggttaaagggactgagcagagggctcccgactgctgagctacgaggaagagggggcagtggagagcacactgagggctcagtgttgatgacatccagcctcctcgtgccagaggtccaggtcctcctggtgcaggagcagaagctgctcaggatcctgcagagatggtggcagagcccaggtagaacctggcaccctgttgcctccaagaccacctcagatgctggtttggccgcctcccatgcctccttcccctttgccagcagctcagtccttcaagagcagggccttggcaggtctgtcttaaaacaccgtgggagtctggccatcatcctggcctagcactgctgtgccctgtccctggggttgtgggaagctggtagcatcctggcagcccgaggagagaagggctcccccagaagcatgtgcccagcaagtcacagtctgcagagtcagccctctcaccagatttcctggggctcagggattccgtccccttcttcccagccccttgagagtgtgtggcagcgctggcagctctgagcgcctattgatctctctgctggcagccaggtgcgcctgcgtccgcctcctctcctcagcttctgctgaaacgacttcactttctcatgtctcctcccacctccctttctctccagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378175 - DNA, 1966 bp, Homo sapiens
cctttcccaaatttaaaatcttgcaagagatagtacaacaaaggtagcccagttcttcctcagtgccatcctggtgtgttcaggttttttggcaaaacctttgaggactacgaggaagagggggcagtggagagcacactgagggctcagtgttgatgacatccagcctcctcgtgccagaggtccaggtcctcctggtgcaggagcagaagctgctcaggatcctgcagagatggtggcagagcccaggtagaacctggcaccctgttgcctccaagaccacctcagatgctggtttggccgcctcccatgcctccttcccctttgccagcagctcagtccttcaagagcagggccttggcaggtctgtcttaaaacaccgtgggagtctggccatcatcctggcctagcactgctgtgccctgtccctggggttgtgggaagctggtagcatcctggcagcccgaggagagaagggctcccccagaagcatgtgcccagcaagtcacagtctgcagagtcagccctctcaccagatttcctggggctcagggattccgtccccttcttcccagccccttgagagtgtgtggcagcgctggcagctctgagcgcctattgatctctctgctggcagccaggtgcgcctgcgtccgcctcctctcctcagcttctgctgaaacgacttcactttctcatgtctcctcccacctccctttctctccagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378176 - DNA, 1543 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378177 - DNA, 2097 bp, Homo sapiens
cctttcccaaatttaaaatcttgcaagagatagtacaacaaaggtagcccagttcttcctcagtgccatcctggtgtgttcaggttttttggcaaaacctttgaggagctggtgggtggcaggactaggttaaagggactgagcagagggctcccgactgctgagctacgaggaagagggggcagtggagagcacactgagggctcagtgttgatgacatccagcctcctcgtgccagaggtccaggtcctcctggtgcaggagcagaagctgctcaggatcctgcagagatggtggcagagcccaggtagaacctggcaccctgttgcctccaagaccacctcagatgctggtttggccgcctcccatgcctccttcccctttgccagcagctcagtccttcaagagcagggccttggcaggtctgtcttaaaacaccgtgggagtctggccatcatcctggcctagcactgctgtgccctgtccctggggttgtgggaagctggtagcatcctggcagcccgaggagagaagggctcccccagaagcatgtgcccagcaagtcacagtctgcagagtcagccctctcaccagatttcctggggctcagggattccgtccccttcttcccagccccttgagagtgtgtggcagcgctggcagctctgagcgcctattgatctctctgctggcagccaggtgcgcctgcgtccgcctcctctcctcagcttctgctgaaacgacttcactttctcatgtctcctcccacctccctttctctccagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378178 - DNA, 1421 bp, Homo sapiens
tgtcagaagctcgtccaggagccagctgtcccaggtgtctgctggtggcccgccgctttccagacatggaggggacttaaccccgtgagtccatgttgctgcctgggggaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378179 - DNA, 1538 bp, Homo sapiens
gcgtggccagcgggaaggagctggagggttggcgctagattttgcttggccggagtttttttaccattgcctggcagaagcacggagtccaggatttcctggtgtccctggctcacggcctggggtggtggccccacacaccccacacacacacaccccacagagccctgccctgctgtgggcaccggtggtgggcaaaagcttgggctttgtcagaccaggttcccattcccaccccatgtctcaccgtgccctgggcaggtcactgcccctctctggatctgtttcctcactttgaaaagggggctcaccgtcatttgaccctctcagggtcctcaagaagcaccagccccaggcctggcatggaggatgtgctcatttgtcccctgccccagctgagccaggtgggaggaggcagtgggtgcctatctggggaaccttccccctccacccacctctccctgcagccatctctgcagccaggctggtgctgagctcagctacgggaaggtactgacagacacagagccaggtgacacctgaggctgggggaggggtgcaagagctgactcaatatcacccgacatccccaagtcccctcagctgctaggccagtagctctgaggaccctcttgttactaactcatcttctcccttccctgctgcccagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378180 - DNA, 874 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccac

SEQ ID NO: 378181 - DNA, 1019 bp, Homo sapiens
  misc_feature (953)..(953): n is a, c, g, or t
  misc_feature (955)..(955): n is a, c, g, or t
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggncnggggggtggcccggggttctcttaggggccaagccagggtggcggaaactctgttggaaaccgg

SEQ ID NO: 378182 - DNA, 762 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaaggtgagggcctctgcgggccacacgggctggctgtccggagcgccatcctagcaccctgcattgattcctcaggtttcctggcggctctggtttttccagtggccgacatgtgataggctggcaggggcgtgcctgaggcagagtgagcgttgactttagaactggctctcttccttccagttggcattcgcgccctgctcaagtctccgcccccctatctaccgtgtcggtggtgtcggtgcagctgatcaccccttcccaatcccggagcatttgggagtgggagttccattgcagacccaccgcctgccggggag

SEQ ID NO: 378183 - DNA, 794 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccac

SEQ ID NO: 378184 - DNA, 721 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccac

SEQ ID NO: 378185 - DNA, 255 bp, Homo sapiens
tcccgggaatgcaagttgatgaaagtaagtgctgggtgctccggcctcccccttcccgaacctcagacgggggtggctggggctccaggtgggacaatcgccaagacttgtccagtagttctcagagggtgtctttgttttgttttgttttgttttgttttgtttggccatttgagtctccattttccagatgaagaaagtacaactcggggagtgctggagctcaggatggctaggtggacacacacacacaca

SEQ ID NO: 378186 - DNA, 900 bp, Homo sapiens
catccacagtgggagggagggagtgtcacatggggtccccccagcgtgcacggagccctgggtgatggccgagaaaaaggcaggcagctggccccctgggagagaggggcgggcgccgcctctcatgttcccaccgcctgccgccgctctgcccaccgccatgccagcctcccgttggtcctgacagccaggctgcctccttcccactgtctcaggctctcagaaggcccacgaacacctggctacagcctccacccccacccagccaccatcacaccctgatcttggtcgctcacgcactggccgctgacctctccaagctggtccctggctccctgcccttggggtcctgggttaacagggcctcacctcgggacatgaaccagctcccagctggccccccagtgcctggcagtggctctggccctctggctgcttgccctgagctcaccagtgccacttctccatggctacaggtggggaccaatgccatggacagccccctcctcaagtacagcgccaaagactacttcttcaaggcggccctctgccacttctgcatcgacatgctcaacgccaaggtagcacaccccacgcccgcaggaccaccgcaccaggccaccatgtgcttatctccaggccaggtcccgttgcccccgaagagggacgtgctcctccctcacgtctggcccctgccagccagcctttggatgagaagtgtggttctcacagctgtgtttctgtgctggcatcacctgcccacccagccctggaggcttttgcgggtccagctcctgcctcacttagtgctctttccttcatgggtgcactttttgaatcctcactgcaccccattaaagtcagcaccattgtcaccgcgtcttatgggtgaagatggtg

SEQ ID NO: 378187 - DNA, 1895 bp, Homo sapiens
  misc_feature (1895)..(1895): n is a, c, g, or t
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgaaaaaaaaaagcaaaaaaaaaaaaaaaaaaaaaaaaagcgccgagcgatctctagcgggggggggggaaaaagaaggtgtatcagacagggcgccatgtggcaacacagggttttcctgcgaccccctttttgttgacaccagagggggaataaccaggggatccccaatagagagcgcgcaataattgagaaacccggtaagccgttagn

SEQ ID NO: 378188 - DNA, 1595 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378189 - DNA, 1286 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagagccaagctctaaagcacatgtagccgctgagacctgcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378190 - DNA, 1096 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccaggtatgcccttttgggtttatgccacggagcttgcgccatgctcattacagaccgttctctttttttgttttgctgttacaggcatt

SEQ ID NO: 378191 - DNA, 1761 bp, Homo sapiens
acgcgcgatgttcgcggtgtgtcaccgtgggtgcagcacagcggacagcggcgcgcgcgatgcagactgtctaacgacatgtccagggtctgagtatttaaccagtatcttgtagatttcctgtcgagttctcgagctctgtagagcgtagactatctgtgccacagtggttgccagggatctaggcagcgttttggctttgacgtactcgtttgatgtcgctgcactggacgatatccggggaacgcgaatgcaggatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378192 - DNA, 1725 bp, Homo sapiens
  misc_feature (230)..(230): n is a, c, g, or t
  misc_feature (238)..(238): n is a, c, g, or t
  misc_feature (245)..(245): n is a, c, g, or t
  misc_feature (282)..(282): n is a, c, g, or t
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatatgatatggccccgaaggccgggagcgccaaaagttgaaaagaaaacnttcccggnccaaggnttccccattttccaatttttccaatacattggggccntctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378193 - DNA, 1487 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378194 - DNA, 1757 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378195 - DNA, 1705 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggtcgtcggccattgacatctacgaacagtggacaagcctcatacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378196 - DNA, 1449 bp, Homo sapiens
catccacagtgggagggagggagtgtcacatggggtccccccagcgtgcacggagccctgggtgatggccgagaaaaaggcaggcagctggccccctgggagagaggggcgggcgccgcctctcatgttcccaccgcctgccgccgctctgcccaccgccatgccagcctcccgttggtcctgacagccaggctgcctccttcccactgtctcaggctctcagaaggcccacgaacacctggctacagcctccacccccacccagccaccatcacaccctgatcttggtcgctcacgcactggccgctgacctctccaagctggtccctggctccctgcccttggggtcctgggttaacagggcctcacctcgggacatgaaccagctcccagctggccccccagtgcctggcagtggctctggccctctggctgcttgccctgagctcaccagtgccacttctccatggctacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 378197 - DNA, 969 bp, Homo sapiens
  misc_feature (824)..(824): n is a, c, g, or t
  misc_feature (840)..(840): n is a, c, g, or t
  misc_feature (843)..(843): n is a, c, g, or t
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagtggtgtcnaagtgggagtgtccanttnctgtcccggatgagtgtgaaaatgtgagcgagggatgggaggtaccgggcgaggaaaacctccggggccggccccgtggggctcaaaacccgggggcggggccccccggggtttctttaagggggt

SEQ ID NO: 378198 - DNA, 680 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggtgagtggcagcagggccctgcatgggctggcagccaggaccagtgctgctctctcttcttcccaccaggggagtcctctggtgtctgagtgccgagaagggggcatggg

SEQ ID NO: 378199 - DNA, 677 bp, Homo sapiens
gtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccac

SEQ ID NO: 378200 - DNA, 439 bp, Homo sapiens
accctggggttgtggtggggtcaggaactcttcgccccactaccccagcaagcacccagtatctaccccagtactcccggagggagctggtctgcccgaagtgagtgtgccattgtatgcaggggcgggggccacagactcaagaggcctgggggaagctggcttcacaggtgaagggtgaggggtaggggcacgtctgtgcccggcactggagcagaatgcttgctttctcctggatagccgactagattgtctcctttttttctttcctttttccccagaggctcatccaaaatagaggaagcatgcgaaatctacgccagagcagcaaacatgttcaaaatggccaaaaactggagtggtatgtcatctccgctagagctcctccaaggtgctctcctcctccctcagcttccactcacacaggcctgcccgagag

SEQ ID NO: 378201 - DNA, 1865 bp, Homo sapiens
agcgcgacccgacagcctgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378202 - DNA, 1546 bp, Homo sapiens
cttgcgcacgcgcagcccgcccctgcggcagagtggcgcccgcgcgtgactcccccctgccggctgcggaggtgggggggggacggcgcccccgccgtgtgcgtggggcggggatggagcacgcgccctggagccccggagccagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378203 - DNA, 660 bp, Homo sapiens
ggccagcaggcctggttaaatcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378204 - DNA, 458 bp, Homo sapiens
agcgcgacccgacagcctgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaaggtacggaggccgcgagccaggggccgggaaccggctgctgggtggctgggagagcacggccaggggaagccggccagcaggacggagcaagggcggtcaccggaggaaaggggagctcgggggtccagccagactgcgccctttcccat

SEQ ID NO: 378205 - DNA, 1758 bp, Homo sapiens
taacgagcttacggccgcacgcgacactttgtgcgttagtcgtccgcaacactttctgtgccactgcacgcgggcccacgtgcggcagagtggcgcccgcgcgtgactcccccctgccggctgcggaggtgggggggggacggcgcccccgccgtgtgcgtggggcggggatggagcacgcgccctggagccccggagccagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378206 - DNA, 1701 bp, Homo sapiens
cttgcgcacgcgcagcccgcccctgcggcagagtggcgcccgcgcgtgactcccccctgccggctgcggaggtgggggggggacggcgcccccgccgtgtgcgtggggcggggatggagcacgcgccctggagccccggagccagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378207 - DNA, 1738 bp, Homo sapiens
aaacggctggtacgccggaattagggatcatcacgcgtgtgacgcgtgtccctgaacctacctgcgcttcttgtcccaactctaaaatgggaatgataagcgccattcggcagcgccttgtgggtctataatctacttagcacagagagtgtcttctaagtacttcacatccttctctgcagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378208 - DNA, 1587 bp, Homo sapiens
gtacggtccggaatcctggatcgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378209 - DNA, 1758 bp, Homo sapiens
  misc_feature (1695)..(1695): n is a, c, g, or t
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcaaaaaaaaaanaaacacacaacaacaaaaaacaacaaccaaccacaaccaaaaagcggggccccactacaaaac

SEQ ID NO: 378210 - DNA, 2659 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcaaaaaaaaaaaaaaaaaaaaaaaaaaaaaaaaaaacaaaaaaaaaaaaaaaaacaaaaaagaaaacaaagagaaacaaaaaaaacaaaaaaaaaaaagaaaaaaaaaaagaaaaaaaacaaaagaaaaaccaaacaaacacaggacacaacacaaaaaacaccacacaaagacagacaaacaaaaaatagaagggagggggcccgcccgcatacctcccctgcgggcgcgaggcaccacacggcgccagccacaatgtggggcaggagccccggcgaggggtaataactaacaatataggcaaggcacgccacgcggcggtatctaaacacaccggctggctggagtactaacaccactacgagtcagatcacggttatattaagtacggaaccacacccactacatttgtggcgtggggggagtcaaccatattcatccgacacatgccctcacaaagacaattcgtaccgacacgccacgactagttagcatgatctacaacacatttctacagtcgcttgtctgagtgataacacccacccgtactatctgcttcctgctagacaaataattcttgggtcaccagtagctatcagcgtcagtaacaaaacttacggtcgcgcgcgcggggctgggatcttatctcagttagtaggcctgccaagtagaagtatgcaaggatactgaacatgaacgattctacagaaaacaaacttgtgaagagaatgaacattcaaacgcgcaaggcgaaatcgagaatgaagagcacgatgaagcaaatacaaaaaaacacagactataataccgacaaaagaagtcgaaccaacctccacaacacggacgaagaaagaagcgcaaaagcaatacaccttaccgaagaaggaatgacgaagacgagtaaaatcacaggagacgacagacaatgtgccagtacgataacgtgaacataaggaactacagatagagatggagg

SEQ ID NO: 378211 - DNA, 2013 bp, Homo sapiens
cttgcgcacgcgcagcccgcccctgcggcagagtggcgcccgcgcgtgactcccccctgccggctgcggaggtgggggggggacggcgcccccgccgtgtgcgtggggcggggatggagcacgcgccctggagccccggagccagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggttgggttctcttcaagcagaggctgagacagggagcttcctgtgggcgacttactgagagaagtgaggacaggaggagagtgaattgcatcagagcgcgagtcctgccttgagcccggagccagcttgttattccccttccaccagccactggcttaggctccctgctggagcagagggccctgcgtcccaagtatttcccaagaggcaggtccttcagcagagggaggggaggaatggccaggccgaggccatctgggtagggcaccaacaagcccagatggacagcatgtgccccggcccggcccgcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378212 - DNA, 1801 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccaccgtgcgtgcagggcctgctggcccgggaggggacctgcctgggctgggggctggagaggggaggggctgctggatggagtggctgctgctggacacgccccatgcccacccactaggctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378213 - DNA, 1609 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378214 - DNA, 1854 bp, Homo sapiens
aaacggctggtacgccggaattagggatcatcacgcgtgtgacgcgtgtccctgaacctacctgcgcttcttgtcccaactctaaaatgggaatgataagcgccattcggcagcgccttgtgggtctataatctacttagcacagagagtgtcttctaagtacttcacatccttctctgcagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccaccgtgcgtgcagggcctgctggcccgggaggggacctgcctgggctgggggctggagaggggaggggctgctggatggagtggctgctgctggacacgccccatgcccacccactaggctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378215 - DNA, 852 bp, Homo sapiens
agaatttgagtccttggccaggcgtggcctcctgttcttggcttgccaggctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378216 - DNA, 1065 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactggtgagccccgccctggcct

SEQ ID NO: 378217 - DNA, 1065 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgctgggacccacagaaccaactccccagcctttcagccttcgcttggtatcccat

SEQ ID NO: 378218 - DNA, 1269 bp, Homo sapiens
acccacgcgtcctgcccacgcgtcgagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcaaaaaaaaaaaaaaaaaaaaaaaaaaaaaaaaaaacaaaaaaaaaaaaaaaaacaaaaaagaaaacaaagagaaacaaaaaaaacaaaaaaaaaaaagaaaaaaaaaaagaaaaaaaacaaaagaaaaaccaaacaaacacaggacacaacacaaaaaacaccacacaaagacagacaaacaaaaaatagaagggagggggcccgcccgcatacctcccctgcgggcgcgaggcaccacacggcgccagccacaatgtggggcaggagccccggcgaggggtaataactaacaatataggcaaggcacgccacgcggcggtatctaaacacaccggctggctggagtactaacaccactacgagtcagatcacggttatattaagtacggaaccacacccactacatttgtggcgtggggggagtcaaccatattcatccgacacatgccctcacaaagacaattcgtaccgacacgccacgactagttagcatgatctacaacacatttctacagtcgcttgtctgagtgataacacccacccgtactatctgcttcctgctagacaaataattcttgggtcaccagtagctatcagcgtcagtaacaaaacttacggtcgcgcgcgcggggctgggatcttatctcagttagtaggcctgccaagtagaagtatgcaaggatactgaacatgaacgattctacagaaaacaaacttgtgaagagaatgaacattcaaacgcgcaaggcgaaatcgagaatgaagagcacgatgaagcaaatacaaaaaaacacagactataataccgacaaaagaagtcgaaccaacctccacaacacggacgaagaaagaagcgcaaaagcaatacaccttaccgaagaaggaatgacgaagacgagtaaaatcacaggagacgacagacaatgtgccagtacgataacgtgaacataaggaactacagatagagatggagg

SEQ ID NO: 378219 - DNA, 1685 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378220 - DNA, 1708 bp, Homo sapiens
  misc_feature (10)..(10): n is a, c, g, or t
gcaggctggntacggtccgaagtccgtttgtgcggcagagtggcgcccgcgcgtgactcccccctgccggctgcggaggtgggggggggacggcgcccccgccgtgtgcgtggggcggggatggagcacgcgccctggagccccggagccagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378221 - DNA, 1655 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378222 - DNA, 1723 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaagcaaatgtcgatgcagagataaa

SEQ ID NO: 378223 - DNA, 1671 bp, Homo sapiens
cttgcgcacgcgcagcccgcccctgcggcagagtggcgcccgcgcgtgactcccccctgccggctgcggaggtgggggggggacggcgcccccgccgtgtgcgtggggcggggatggagcacgcgccctggagccccggagccagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378224 - DNA, 1945 bp, Homo sapiens
  misc_feature (10)..(10): n is a, c, g, or t
gcaggctggntacggtccgaagtccgtttgtgcggcagagtggcgcccgcgcgtgactcccccctgccggctgcggaggtgggggggggacggcgcccccgccgtgtgcgtggggcggggatggagcacgcgccctggagccccggagccagatcacgcgtgtgacgcgtgtccctgaacctacctgcgcttcttgtcccaactctaaaatgggaatgataagcgccattcggcagcgccttgtgggtctataatctacttagcacagagagtgtcttctaagtacttcacatccttctctgcagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggtatctgtgatccttgatctctaaactcctgagctctggtgggtcgacctgagcacagccaagcttcagttcagcctgtgtcccgttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378225 - DNA, 1872 bp, Homo sapiens
atgagtgggaggtgaggacgtggaactagaaaaatgggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcagaggctgagacagggagcttcctgtgggcgacttactgagagaagtgaggacaggaggagagtgaattgcatcagagcgcgagtcctgccttgagcccggagccagcttgttattccccttccaccagccactggcttaggctccctgctggagcagagggccctgcgtcccaagtatttcccaagaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378226 - DNA, 1199 bp, Homo sapiens
  misc_feature (3)..(3): n is a, c, g, or t
ggnacgaggaagttgagatcatacatgcggatgtgctggtaacctgcagcagcaatcatgctggggtccggtgtgacctccaaggcattcacctgggagtcctggtgctgcaccccaagcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378227 - DNA, 1740 bp, Homo sapiens
agcgcgacccgacagcctgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgca

SEQ ID NO: 378228 - DNA, 1094 bp, Homo sapiens
agcgcgacccgacagcctgggaaacggacagccgtgtcagaagggcaggtgccagtgggcaggaggccggagagaaagccgcagcttccttccacctcgcgccgggcccgcggccgcgcacggggaccgctccgagttcctcccggcgggaaccccccgccccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccgaaactgtatgtctggattctgacgggggccttggtgacgaggtggcccgtctttccccaggatagattccggcccagcgctaggctgtgttttgtttgccgatccagctctgccctgtcgtgtcgcgtggctgggggcgctccggggggggtaagc
